United States Patent 12,622,926 (IMMUNOTHERAPY TARGETING TUMOR NEOANTIGENIC PEPTIDES) - sequence listing, part 3

SEQ ID NO: 8261 - DNA, 2198 bp, Artificial Sequence
  Synthetic polypeptide
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8262 - DNA, 2150 bp, Artificial Sequence
  Synthetic polypeptide
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8263 - DNA, 2186 bp, Artificial Sequence
  Synthetic polypeptide
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8264 - DNA, 2228 bp, Artificial Sequence
  Synthetic polypeptide
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8265 - DNA, 1026 bp, Artificial Sequence
  Synthetic polypeptide
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctg

SEQ ID NO: 8266 - DNA, 806 bp, Artificial Sequence
  Synthetic polypeptide
gccaggcacagtggctcacgccagtaatcccagcactttgggaggccgaggcaggaggatcacttgagcccaggaatctgagaccagcttgagcaatatggcaaaaccctgtcgctacaaaaattacccaggtgtggtggagcacacctgtagtcccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtag

SEQ ID NO: 8267 - DNA, 509 bp, Artificial Sequence; identical to SEQ ID NO: 7445
  Synthetic polypeptide

SEQ ID NO: 8268 - DNA, 2120 bp, Artificial Sequence; identical to SEQ ID NO: 6752
  Synthetic polypeptide

SEQ ID NO: 8269 - DNA, 192 bp, Artificial Sequence
  Synthetic polypeptide
gccaggcgtggaggcttacacctgtaatcctagcattttgggaggccaagcccatctgctggcaaggctaagattagaacagctcataggagagtcatgattttgaatcacccagataaaggtggatctccttacgtagcagccaaaataaatgaagcaaaagacttgctagaaacaaccaccaaacattga

SEQ ID NO: 8270 - DNA, 871 bp, Artificial Sequence; identical to SEQ ID NO: 437
  Synthetic polypeptide

SEQ ID NO: 8271 - DNA, 421 bp, Artificial Sequence; identical to SEQ ID NO: 441
  Synthetic polypeptide

SEQ ID NO: 8272 - DNA, 638 bp, Artificial Sequence; identical to SEQ ID NO: 442
  Synthetic polypeptide

SEQ ID NO: 8273 - DNA, 337 bp, Artificial Sequence; identical to SEQ ID NO: 443
  Synthetic polypeptide

SEQ ID NO: 8274 - DNA, 995 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctag

SEQ ID NO: 8275 - DNA, 204 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctga

SEQ ID NO: 8276 - DNA, 461 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagcctttcgattaccaggcattggtattagatactgtgatgtgtgcagttacttcttgcagtccttcccttgaccttgtggccttgaagttcctggcactcccagttccagattag

SEQ ID NO: 8277 - DNA, 339 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccg

SEQ ID NO: 8278 - DNA, 308 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaac

SEQ ID NO: 8279 - DNA, 305 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtg

SEQ ID NO: 8280 - DNA, 284 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 8281 - DNA, 247 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcct

SEQ ID NO: 8282 - DNA, 210 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagca

SEQ ID NO: 8283 - DNA, 149 bp, Artificial Sequence
  Synthetic polypeptide
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccc

SEQ ID NO: 8284 - DNA, 632 bp, Artificial Sequence
  Synthetic polypeptide
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagcctcccagcgtgcggcctgccaacccagctcccattacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggtgtggatcttgtgtgaagctcactgcctcaaggtggccgtggatggtcagcacgtgtttgaatactaccatcgcctga

SEQ ID NO: 8285 - DNA, 416 bp, Artificial Sequence
  Synthetic polypeptide
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagccgatgcctttcatcaccaccattccgggagggctgtacccatccaagtccatcatcctgtcaggcactgtcctgcccagt

SEQ ID NO: 8286 - DNA, 962 bp, Artificial Sequence
  Synthetic polypeptide
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacatag

SEQ ID NO: 8287 - DNA, 863 bp, Artificial Sequence
  Synthetic polypeptide
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagcctcccagcgtgcggcctgccaacccagctcccattacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacatag

SEQ ID NO: 8288 - DNA, 596 bp, Artificial Sequence
  Synthetic polypeptide
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggtgtggatcttgtgtgaagctcactgcctcaaggtggccgtggatggtcagcacgtgtttgaatactaccatcgcctga

SEQ ID NO: 8289 - DNA, 1965 bp, Artificial Sequence
  Synthetic polypeptide
ggacaggtgcatggctcacacctataatcccagtgctttgggaggccgaagtggtaggatcgcttgagcccaggagtttgagaccagcctgggcaacaaagtgagacccttgtctctacaaaaaatacaaaaattagctgagtgtggtggtgcatacctgcagttccacctacttgggaggctgaggtggcaggatcgcttgagttgaggagatggaggctgcagtgaactgcgatcacgccactgcattccagcctgggcaacagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 8290 - DNA, 1031 bp, Artificial Sequence
  Synthetic polypeptide
gccaggtgcagtggctcgtgcctgtaatcctagcactttgggtggccaaggtgggaggattgcttgagcccaggagttcaagaccagccttggcaacatgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctga

SEQ ID NO: 8291 - DNA, 857 bp, Artificial Sequence
  Synthetic polypeptide
gccaggtgcagtggctcgtgcctgtaatcctagcactttgggtggccaaggtgggaggattgcttgagcccaggagttcaagaccagccttggcaacatgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctga

SEQ ID NO: 8292 - DNA, 80 bp, Artificial Sequence; identical to SEQ ID NO: 6364
  Synthetic polypeptide

SEQ ID NO: 8293 - DNA, 217 bp, Artificial Sequence; identical to SEQ ID NO: 6365
  Synthetic polypeptide

SEQ ID NO: 8294 - DNA, 330 bp, Artificial Sequence; identical to SEQ ID NO: 6490
  Synthetic polypeptide

SEQ ID NO: 8295 - DNA, 353 bp, Artificial Sequence
  Synthetic polypeptide
gggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatag

SEQ ID NO: 8296 - DNA, 421 bp, Artificial Sequence
  Synthetic polypeptide
gggtggagccaagatggccgaataggaacagctccagtctacagctcccagcatgagcgacacagaagacgggtgctttctgcatttccagctgaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctag

SEQ ID NO: 8297 - DNA, 244 bp, Artificial Sequence
  Synthetic polypeptide
gggtggagccaagatggccgaataggaacagctccagtctacagctcccagcatgagcgacacagaagacgggtgctttctgcatttccagctgaggttacagtcttcttcataccttgatgattcgagtccaacaggtttaatgaaagatactcatactgtaaactgcaggagtgtgatggtgcacagttggatttcgatgccctatgtgacaatgatgacacagccatggctgcatttatga

SEQ ID NO: 8298 - DNA, 303 bp, Artificial Sequence; identical to SEQ ID NO: 6723
  Synthetic polypeptide

SEQ ID NO: 8299 - DNA, 189 bp, Artificial Sequence; identical to SEQ ID NO: 6724
  Synthetic polypeptide

SEQ ID NO: 8300 - DNA, 318 bp, Artificial Sequence; identical to SEQ ID NO: 6725
  Synthetic polypeptide

SEQ ID NO: 8301 - DNA, 138 bp, Artificial Sequence; identical to SEQ ID NO: 6726
  Synthetic polypeptide

SEQ ID NO: 8302 - DNA, 2448 bp, Artificial Sequence; identical to SEQ ID NO: 6618
  Synthetic polypeptide

SEQ ID NO: 8303 - DNA, 1543 bp, Artificial Sequence; identical to SEQ ID NO: 6619
  Synthetic polypeptide

SEQ ID NO: 8304 - DNA, 1468 bp, Artificial Sequence; identical to SEQ ID NO: 6620
  Synthetic polypeptide

SEQ ID NO: 8305 - DNA, 1498 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 8306 - DNA, 1195 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttga

SEQ ID NO: 8307 - DNA, 1462 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactga

SEQ ID NO: 8308 - DNA, 1489 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 8309 - DNA, 1180 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaa

SEQ ID NO: 8310 - DNA, 1110 bp, Artificial Sequence
  Synthetic polypeptide
ggccaggcgcagtggctcactcctgtaatcccagcactttgggaggccgaggcaggaggatcatttgaggtcaagagttcaagaccagcctgaccaacaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattga

SEQ ID NO: 8311 - DNA, 2887 bp, Artificial Sequence
  Synthetic polypeptide
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagttcaatctcatccctcccagcagctccccttccaccccccggggaactga

SEQ ID NO: 8312 - DNA, 2941 bp, Artificial Sequence
  Synthetic polypeptide
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcctccccttccaccccccggggaactgaagattgtcctggccgcgacctga

SEQ ID NO: 8313 - DNA, 2980 bp, Artificial Sequence
  Synthetic polypeptide
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtga

SEQ ID NO: 8314 - DNA, 2887 bp, Artificial Sequence
  Synthetic polypeptide
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagctccccttccaccccccggggaactgaagattgtcctggccgcgacctga

SEQ ID NO: 8315 - DNA, 3046 bp, Artificial Sequence
  Synthetic polypeptide
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattctatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttag

SEQ ID NO: 8316 - DNA, 2959 bp, Artificial Sequence
  Synthetic polypeptide
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagctcccccttttcttccagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactga

SEQ ID NO: 8317 - DNA, 2941 bp, Artificial Sequence
  Synthetic polypeptide
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactga

SEQ ID NO: 8318 - DNA, 940 bp, Artificial Sequence
  Synthetic polypeptide
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttct

SEQ ID NO: 8319 - DNA, 1571 bp, Artificial Sequence; identical to SEQ ID NO: 6810
  Synthetic polypeptide

SEQ ID NO: 8320 - DNA, 309 bp, Artificial Sequence
  Synthetic polypeptide
ggccgggcacggtggctcacgcctataatcccagcactttgggaggccgaggcgggtggatcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctag

SEQ ID NO: 8321 - DNA, 163 bp, Artificial Sequence
  Synthetic polypeptide
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgaggctcagaacacaa

SEQ ID NO: 8322 - DNA, 681 bp, Artificial Sequence
  Synthetic polypeptide
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatag

SEQ ID NO: 8323 - DNA, 295 bp, Artificial Sequence
  Synthetic polypeptide
tttggcgtgcaacatggggcttgagaaaggtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgca

SEQ ID NO: 8324 - DNA, 1117 bp, Artificial Sequence
  Synthetic polypeptide
tttggcgtgcaacatggggcttgagaaaggtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtga

SEQ ID NO: 8325 - DNA, 931 bp, Artificial Sequence
  Synthetic polypeptide
tttggcgtgcaacatggggcttgagaaaggtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggaatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtag

SEQ ID NO: 8326 - DNA, 336 bp, Artificial Sequence; identical to SEQ ID NO: 7520
  Synthetic polypeptide

SEQ ID NO: 8327 - DNA, 346 bp, Artificial Sequence; identical to SEQ ID NO: 7521
  Synthetic polypeptide

SEQ ID NO: 8328 - DNA, 630 bp, Artificial Sequence
  Synthetic polypeptide
tgggttcaaatgctggttctgcaatttaccttctgccttaccaaaaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgaggtgggatga

SEQ ID NO: 8329 - DNA, 2061 bp, Artificial Sequence
  Synthetic polypeptide
tgggttcaaatgctggttctgcaatttaccttctgccttaccaaaaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccaggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactatgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctga

SEQ ID NO: 8330 - DNA, 100 bp, Artificial Sequence
  Synthetic polypeptide
gccgggtgcagtggctcactcctgtaatcccagcactttgggaggccgatgcaggaaacgccagacttctatcctcattcaaaaatctgggccttgctga

SEQ ID NO: 8331 - DNA, 418 bp, Artificial Sequence
  Synthetic polypeptide
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcaagactgggtttcaccgtgttagccaggatggtcttgatctcctgacctcgtga

SEQ ID NO: 8332 - DNA, 488 bp, Artificial Sequence
  Synthetic polypeptide
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcactactctgacccatggatcccctgggcccagccaagccacagtggctgtggcgccgctgtctggccgggctgctgtttcagctgctggtggctgtgtgtttcttctcctacctgcgtgtgtcc

SEQ ID NO: 8333 - DNA, 563 bp, Artificial Sequence
  Synthetic polypeptide
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagacactggcagtgagcgcccaagaggctcctgctgtgcccgtctcgaggcccttgctcttcccgtctaccccgcagctgctgtcggggccgtgtttggcctcaccacctgcatcagcgcccatgtccgcgagaagcccgacgaccccctgaactacttcctcggtggctgcgccggaggcctgactctgggagcacgcactactctgacccatggatcccctgggcccagccaagccacagtggctgtggcgccgctgtctggccgggctgctgtttcagctgctggtggctgtgtgtttcttctcctacctgcgtgtgtcc

SEQ ID NO: 8334 - DNA, 739 bp, Artificial Sequence
  Synthetic polypeptide
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcaagacaggatctcactgtgttgtgcaggctggtctcaaactcctggcctcgagcagtcctcacacctcagcctcccagagtgctgggattataggcatgagccactgtgtacagagattctgggtcccttcttccagcgcctgcctcgaagtcctctctggagagagcacagatgtccacgcgtgttccagcacaaggggggcatgcaacagctcagggtcacgtccacttccggagctgggtgcccgggcctcgggctccctgagaaagggcggacacacccaccccgcacccagaggggcaggggccctgacacctgtccaagccctaatagagtcattgttaaacactctgggttcgaaccccagaacttga

SEQ ID NO: 8335 - DNA, 415 bp, Artificial Sequence
  Synthetic polypeptide
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcagtgagtggccccctccccacccccaccctcctcccagcctggcagaatga

SEQ ID NO: 8336 - DNA, 478 bp, Artificial Sequence
  Synthetic polypeptide
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtga

SEQ ID NO: 8337 - DNA, 4233 bp, Artificial Sequence
  Synthetic polypeptide
agcctccaagatagctctgaatgatccttatttccttgtatttactcccttgtatagtcccctgcaacactgaacggggctgtcctgagtaacggaacaggctgtggtagaagtgacaatgtatgcttttcaaggttaggtcgtaaaagactgccacttcatatttgctctcttggatcttgcaccaggggaaaaccaactgccttttcacttgagctgtctagaaaggcccatgtagtgtggaactgaagcctttcaacaacagcaagtgtcaacttagaaccgtaagaatgagttaccttcaaaacacaccctccacgcccagtcaagccttcagataactgcagccttgaccagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgctaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaa

SEQ ID NO: 8338 - DNA, 2022 bp, Artificial Sequence
  Synthetic polypeptide
agcctccaagatagctctgaatgatccttatttccttgtatttactcccttgtatagtcccctgcaacactgaacggggctgtcctgagtaacggaacaggctgtggtagaagtgacaatgtatgcttttcaaggttaggtcgtaaaagactgccacttcatatttgctctcttggatcttgcaccaggggaaaaccaactgccttttcacttgagctgtctagaaaggcccatgtagtgtggaactgaagcctttcaacaacagcaagtgtcaacttagaaccgtaagaatgagttaccttcaaaacacaccctccacgcccagtcaagccttcagataactgcagccttgaccagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgctaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtggttagtaaatcatacttcacactttttctctag

SEQ ID NO: 8339 - DNA, 636 bp, Artificial Sequence
  Synthetic polypeptide
ctgggtgcggtggctcttacctacaatcccagcaccttgagaggccagaggaggatcgcttgaggccagaagtttgagatcgcctgggcaacaaagcacaacctcatctctgcaaaaaaatttaaaagttagccaggtgtggtggcacatgcctgtagtctcagctgcttgggaggctaaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaa

SEQ ID NO: 8340 - DNA, 1062 bp, Artificial Sequence
  Synthetic polypeptide
gtggaaacaacccaaatatgtatcaactggtaaatggataaacaaagcacactgcatgctccacaatggatgaaacttagaaccttaaaaacatcatgctgagtgaaagaagccagacacaaaaggccatgtatcatgggattccattcatgtcaaatgtccaaaacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaa

SEQ ID NO: 8341 - DNA, 74 bp, Artificial Sequence; identical to SEQ ID NO: 7010
  Synthetic polypeptide

SEQ ID NO: 8342 - DNA, 1023 bp, Artificial Sequence; identical to SEQ ID NO: 611
  Synthetic polypeptide

SEQ ID NO: 8343 - DNA, 588 bp, Artificial Sequence; identical to SEQ ID NO: 7495
  Synthetic polypeptide

SEQ ID NO: 8344 - DNA, 4725 bp, Artificial Sequence
  Synthetic polypeptide
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8345 - DNA, 4530 bp, Artificial Sequence
  Synthetic polypeptide
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagggtgatcgtcttggacaaaggagaaatccaggagtacggcgccccatcggacctcctgcagcagagaggtcttttctacagcatggccaaagacgccggcttggtgtga

SEQ ID NO: 8346 - DNA, 4557 bp, Artificial Sequence
  Synthetic polypeptide
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8347 - DNA, 4380 bp, Artificial Sequence
  Synthetic polypeptide
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8348 - DNA, 4548 bp, Artificial Sequence
  Synthetic polypeptide
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8349 - DNA, 4755 bp, Artificial Sequence
  Synthetic polypeptide
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8350 - DNA, 1790 bp, Artificial Sequence
  Synthetic polypeptide
cccaaaatcctccccgcagaccctactgctggtgacaaatctctcactggcctatagcagtgtacaactctgagcgttgtgacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtag

SEQ ID NO: 8351 - DNA, 913 bp, Artificial Sequence
  Synthetic polypeptide
cagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8352 - DNA, 718 bp, Artificial Sequence
  Synthetic polypeptide
cagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagggtgatcgtcttggacaaaggagaaatccaggagtacggcgccccatcggacctcctgcagcagagaggtcttttctacagcatggccaaagacgccggcttggtgtga

SEQ ID NO: 8353 - DNA, 852 bp, Artificial Sequence; identical to SEQ ID NO: 753
  Synthetic polypeptide

SEQ ID NO: 8354 - DNA, 2405 bp, Artificial Sequence
  Synthetic polypeptide
ggccaggcgcagtggctcacacctgtaatcccagcactttgggaggccgaggcaggtcaggattttactggaatggcgtggctgtcttccccaagcctccccaagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtga

SEQ ID NO: 8355 - DNA, 2252 bp, Artificial Sequence
  Synthetic polypeptide
ggccaggcgcagtggctcacacctgtaatcccagcactttgggaggccgaggcaggtcaggattttactggaatggcgtggctgtcttccccaagcctccccaagatggggtgtaccccaacatgagtgagcctgtcaccccagccaacatcaacctctatgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtga

SEQ ID NO: 8356 - DNA, 2240 bp, Artificial Sequence
  Synthetic polypeptide
ggccaggcgcagtggctcacacctgtaatcccagcactttgggaggccgaggcaggtcaggattttactggaatggcgtggctgtcttccccaagcctccccaagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggtgaacttccccacccccatccagaccataagccagggaagcaaaccctag

SEQ ID NO: 8357 - DNA, 2148 bp, Artificial Sequence
  Synthetic polypeptide
ggccaggcacagtggctcacgcctgtaatccctgcactttgggaggctgaggctggcggatcacctgagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctga

SEQ ID NO: 8358 - DNA, 2019 bp, Artificial Sequence
  Synthetic polypeptide
ggccaggcacagtggctcacgcctgtaatccctgcactttgggaggctgaggctggcggatcacctgagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctga

SEQ ID NO: 8359 - DNA, 544 bp, Artificial Sequence
  Synthetic polypeptide
gaaaggtagcatggtgggatggaatgagcacaaggtgcccagagttagaaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgatatgggccctcacattttccaaacctgtccatctgctaactattttgactgcagagccatgtccattggagcccgttcccaatcagctcgtacttacttggagagacatatgtctgaatttatggagtgtaatttaa

SEQ ID NO: 8360 - DNA, 841 bp, Artificial Sequence
  Synthetic polypeptide
gaaaggtagcatggtgggatggaatgagcacaaggtgcccagagttagaaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaa

SEQ ID NO: 8361 - DNA, 2850 bp, Artificial Sequence; identical to SEQ ID NO: 512
  Synthetic polypeptide

SEQ ID NO: 8362 - DNA, 477 bp, Artificial Sequence; identical to SEQ ID NO: 513
  Synthetic polypeptide

SEQ ID NO: 8363 - DNA, 1795 bp, Artificial Sequence; identical to SEQ ID NO: 879
  Synthetic polypeptide

SEQ ID NO: 8364 - DNA, 1171 bp, Artificial Sequence; identical to SEQ ID NO: 880
  Synthetic polypeptide

SEQ ID NO: 8365 - DNA, 2471 bp, Artificial Sequence; identical to SEQ ID NO: 576
  Synthetic polypeptide

SEQ ID NO: 8366 - DNA, 657 bp, Artificial Sequence
  Synthetic polypeptide
ggctgggcacagtggctcaagcctgcaatcccagcactttgggaggccgtggcgggtggatcacgaggtcaggagatcgagaccatcctggctaacacgtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatga

SEQ ID NO: 8367 - DNA, 310 bp, Artificial Sequence
  Synthetic polypeptide
ggctgggcacagtggctcaagcctgcaatcccagcactttgggaggccgtggcgggtggatcacgaggtcaggagatcgagaccatcctggctaacacgtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagaca

SEQ ID NO: 8368 - DNA, 1927 bp, Artificial Sequence
  Synthetic polypeptide
tgaatacacttatccatacattataataacctgaagcttttaaaaaatattaatgtggatctacatgcaccaataagggaaagttataaaataaagtgggggaaagatgcagaacagcaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtatttggctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggaagcagttggctatcttggctgacctagtgaaagatttaccactggagtttgacttcctcttttcacagtctcaagcagaagtgatctctgggaagcaggaaggggtttatgcatggattggaatcaactttgttttgggaagattcgaccacgaggatgaatcagatgctgaggctacccaggaattggcagcaggacggagaaggacagtagggatactggatatgggaggagcctctctccaaattgcttatgaagttcctacctcaacctctgtccttcctgcaaagcaggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtga

SEQ ID NO: 8369 - DNA, 466 bp, Artificial Sequence
  Synthetic polypeptide
gagccaagatggccaaataggaacagctccggtctacagctcccagcatgagcgacgcagaagatgggtgatttctgcatttccatctgagtatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaa

SEQ ID NO: 8370 - DNA, 526 bp, Artificial Sequence
  Synthetic polypeptide
gagccaagatggccaaataggaacagctccggtctacagctcccagcatgagcgacgcagaagatgggtgatttctgcatttccatctgagtatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataa

SEQ ID NO: 8371 - DNA, 319 bp, Artificial Sequence
  Synthetic polypeptide
gagccaagatggccaaataggaacagctccggtctacagctcccagcatgagcgacgcagaagatgggtgatttctgcatttccatctgagtatgctgtctggctagtcctctgggttacgtggaatgtgtttgttatctgcttctatttggaggctggggacctctcaaagctggcaggtttcatctacgcctgttatgttgtgaaatgtataactgaagaagaggacagctttgatttcataggtggctttgactcttatggctatcaagggcctcagaagacatctcatttacaactacagcctatgtacatgtaa

SEQ ID NO: 8372 - DNA, 520 bp, Artificial Sequence
  Synthetic polypeptide
gagccaagatggccaaataggaacagctccggtctacagctcccagcatgagcgacgcagaagatgggtgatttctgcatttccatctgagtatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtaa

SEQ ID NO: 8373 - DNA, 287 bp, Artificial Sequence; identical to SEQ ID NO: 7101
  Synthetic polypeptide

SEQ ID NO: 8374 - DNA, 281 bp, Artificial Sequence; identical to SEQ ID NO: 7102
  Synthetic polypeptide

SEQ ID NO: 8375 - DNA, 1453 bp, Artificial Sequence
  Synthetic polypeptide
agttctggggccttgggtaggtcacctcatcaacctcagccttgctctcctcattggtaaaaagcggggaagagtttctaccttggattttgatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttag

SEQ ID NO: 8376 - DNA, 4599 bp, Artificial Sequence
  Synthetic polypeptide
ctccccctccctccctccccctctccctctccctctccccacggtctccctctgcctctctttccacggtctccctctgatgccgagccgaagctggactgtactgccgccatctctgctcactgcaacctccctgcctgattctcctgcctcaacctgccgagtgcctgcaattgcaggcacgcgccgccacgcctgactggttttcgtatttttttggtggagacggggtttcgctgtgttggccaggcaggtctctagctcctaaccgggagtaatctgccagcctcagcctcccgaggtgccgggattgcagatggagtcttgttcactcagtgctcaatgttgcccaggctggagtgcagcggcgtgatcttggctcactacaacctccacctcccagccgcctgccttggcctcccaaagtgccgagattgcagcctctgcctggccgccaccccatctgggaagtgaggagcgtctctgcctggccgcccatcgtctgggatgtgaggagcccctctgcccggctgcccagtctgggaagtgaggagcgcctcttcccggccgccatcccgtctaggaagtgaggagcgtctctgcccggccgcccatcgtctgagatgtggggagcgcctctgccccgccaccccatctgggatgtgaggagcgcctctgcccggccgcgaccccgtctgggaggtgaggagcatctctgcccggccaccccgtctgagaagtgaggagcccctctgcccggcagccgccccgtctgacaaattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaa

SEQ ID NO: 8377 - DNA, 1582 bp, Artificial Sequence; identical to SEQ ID NO: 7488
  Synthetic polypeptide

SEQ ID NO: 8378 - DNA, 265 bp, Artificial Sequence
  Synthetic polypeptide
gctatgtggccttggacagatcaccctcaccctctgattaaaaaatttcccatttgcaaatagggctttattacttggatcatatgtgaatctaaggatggacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtga

SEQ ID NO: 8379 - DNA, 333 bp, Artificial Sequence; identical to SEQ ID NO: 6583
  Synthetic polypeptide

SEQ ID NO: 8380 - DNA, 238 bp, Artificial Sequence; identical to SEQ ID NO: 6628
  Synthetic polypeptide

SEQ ID NO: 8381 - DNA, 3882 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtga

SEQ ID NO: 8382 - DNA, 4011 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtga

SEQ ID NO: 8383 - DNA, 1060 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 8384 - DNA, 370 bp, Artificial Sequence; identical to SEQ ID NO: 6522
  Synthetic polypeptide

SEQ ID NO: 8385 - DNA, 2003 bp, Artificial Sequence
  Synthetic polypeptide
caacactgtcaacagaacttcctgcaacggcagacagagggggatgttctgtatctgcacggtcagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatag

SEQ ID NO: 8386 - DNA, 763 bp, Artificial Sequence; identical to SEQ ID NO: 606
  Synthetic polypeptide

SEQ ID NO: 8387 - DNA, 1084 bp, Artificial Sequence; identical to SEQ ID NO: 580
  Synthetic polypeptide

SEQ ID NO: 8388 - DNA, 117 bp, Artificial Sequence
  Synthetic polypeptide
ctgctgctgctgctgcttctgctggtgcccacagtttgtgtgctgcggagatcgcctgatggggcccctgtgcaagtctttgtacctgaaaaaggagagatcatcagccaggtgtaa

SEQ ID NO: 8389 - DNA, 2534 bp, Artificial Sequence; identical to SEQ ID NO: 586
  Synthetic polypeptide

SEQ ID NO: 8390 - DNA, 1731 bp, Artificial Sequence
  Synthetic polypeptide
aatctaatcaagtcttcactacaactaccaacacataggaaaaactaggtgagagaaggcgttatgtgataccaacaggaagcaatgagtcaaatccagaatatgaacattctatagaaacaaacaaacaaaaattccacaaatcaatggcaaataaaagaaaaagacagggttcattacagaataaataaccttaaaagacatggcagccgaattctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggtcgtctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactcttacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcagatcacagcaggcagacatggggacgacctgcgcaacaccaagcaggagattgctgagatcaaccgcatgatccagaggctgagatctgagatcgaccacgtcaagaagcagtgtgccaacctacaggccgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggatgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactga

SEQ ID NO: 8391 - DNA, 423 bp, Artificial Sequence; identical to SEQ ID NO: 6550
  Synthetic polypeptide

SEQ ID NO: 8392 - DNA, 4417 bp, Artificial Sequence
  Synthetic polypeptide
gtatggcataatgaaacgggtccagccttaggagtcaaactgatcttggctcactcaaattcccccactctgccacttctaccttttacaacctagggtcattatttaatttctgtgatcatgaatgataccgagggggtgatgatatctgcgtggtaggttatttatgaagggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaa

SEQ ID NO: 8393 - DNA, 1808 bp, Artificial Sequence
  Synthetic polypeptide
ctctccctctccccctctccccctctccccctctccccctctccccctctcccctttccaccgtctccctctgatgccgagccgaggctggactgtactgccgccatcttggctcactgcaacctccctgcctgattctcctgcctcagcctgccgagtgcctgggattgcaggcgcgtgccgccacgcctgcaatttgtattttttggtggagacggggtttcgctgtgttggccgggctggtctccagctcctgaccgcgagtgatctacccgcctcggcgtcccgaggtgccgggattgcagacggagtctcgctcactcagtgctcaatgttgcccaggctggagtgcagtggcgtgatctcagctcgctacaacctccacctcccagccgcctgccttggcctcccaaagtgccgagattgcagcctctgcctggctgccaccccatctgggaagtgaggagcgtctctgcctggccgcccatcgtctgggatgtgaggagcccctctgcccggccgcccagtcttggaagtgaggagcgcatcttcccggccgccatcacgtctgggaagtgaggagcgtctctgcccggctgcccatcgtctcagatgtggggagcacctctgccccgccgccccgtctgggatgtgaggagcgcctctgtccggccgcgacccggtctgggaactgaggagtgtctctgcccgaccgccaccccgtctgggaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctag

SEQ ID NO: 8394 - DNA, 1218 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 8395 - DNA, 1053 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 8396 - DNA, 942 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 8397 - DNA, 1091 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 8398 - DNA, 785 bp, Artificial Sequence; identical to SEQ ID NO: 6642
  Synthetic polypeptide

SEQ ID NO: 8399 - DNA, 440 bp, Artificial Sequence; identical to SEQ ID NO: 6643
  Synthetic polypeptide

SEQ ID NO: 8400 - DNA, 2158 bp, Artificial Sequence
  Synthetic polypeptide
caccctgtctaaaactgtaacatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcctggcacagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 8401 - DNA, 2224 bp, Artificial Sequence
  Synthetic polypeptide
caccctgtctaaaactgtaacatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcctggcacagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 8402 - DNA, 2143 bp, Artificial Sequence
  Synthetic polypeptide
caccctgtctaaaactgtaacatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcctggcacagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 8403 - DNA, 796 bp, Artificial Sequence
  Synthetic polypeptide
caccctgtctaaaactgtaacatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcctggcacagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaag

SEQ ID NO: 8404 - DNA, 2317 bp, Artificial Sequence
  Synthetic polypeptide
ctggtcccttctgtcatccatctcgtcatcctaccccacacaccttgtattaggaccctcaaccatattaaattattagaattcactagactctctgtggtgtgttcatagtttatgttctttgcaagggttttctttcagcctgtcatgccttttcctttcactgactggcaagttcctaatcattttccaagacttaactgaaataccatctatgagaaactgttttgaacgctctcccacacatctaggttgattagttgctccttgtctgtgctcaggcaacactttatgcttcagttagcacactgtagtgtcatgtttacatattttcttatctgtcttatgtagacttgagcttcctgaaggtagagactgtgaggattattctaattattattattattactgttttggtcattgttttagcatgcctagaacagatccagcacaatgcctgtaacccagtagatgtcagataaatgttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattga

SEQ ID NO: 8405 - DNA, 564 bp, Artificial Sequence
  Synthetic polypeptide
ctcttctgcccttgccgagaactctgtctatatctgtattacaacacttaccatagtgtattcattttacaaggtattgcacccagtgaaccatgaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactga

SEQ ID NO: 8406 - DNA, 198 bp, Artificial Sequence
  Synthetic polypeptide
ggctgagtgcggtggctcacacctgtaatcccagcacttaggacggccaagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctga

SEQ ID NO: 8407 - DNA, 2256 bp, Artificial Sequence
  Synthetic polypeptide
ggttcctcaaaagattaaacatagaactagcatatgatccagcaattctacttatgggtatgcacgcaaaagaagggaagacaggaacttgagagatatttgcacacctgtgttcatagcagcattattcacaatagccaaaaggtggaagcaacccacgtgtccatcagtggatgaatggataaagaaagtgtgatatatacatgcactggaatattattcggccttaaaaagaaaggaaattctgacattctacaacatggaagaactttgatgacattatgctgagtgaaataagccaacagcaaaggacaaatattgtatgattttacttacatgaggtaccatagccaaattcatagaaacagaaagtagaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataa

SEQ ID NO: 8408 - DNA, 2624 bp, Artificial Sequence
  Synthetic polypeptide
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagttcaatctcatccctcccagcagctccccttccaccccccggggaactga

SEQ ID NO: 8409 - DNA, 2678 bp, Artificial Sequence
  Synthetic polypeptide
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcctccccttccaccccccggggaactgaagattgtcctggccgcgacctga

SEQ ID NO: 8410 - DNA, 2717 bp, Artificial Sequence
  Synthetic polypeptide
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtga

SEQ ID NO: 8411 - DNA, 2624 bp, Artificial Sequence
  Synthetic polypeptide
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagctccccttccaccccccggggaactgaagattgtcctggccgcgacctga

SEQ ID NO: 8412 - DNA, 2783 bp, Artificial Sequence
  Synthetic polypeptide
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattctatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttag

SEQ ID NO: 8413 - DNA, 2696 bp, Artificial Sequence
  Synthetic polypeptide
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagctcccccttttcttccagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactga

SEQ ID NO: 8414 - DNA, 2678 bp, Artificial Sequence
  Synthetic polypeptide
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactga

SEQ ID NO: 8415 - DNA, 677 bp, Artificial Sequence
  Synthetic polypeptide
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttct

SEQ ID NO: 8416 - DNA, 739 bp, Artificial Sequence
  Synthetic polypeptide
ccagggggaattttagaaaatgttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattga

SEQ ID NO: 8417 - DNA, 3011 bp, Artificial Sequence
  Synthetic polypeptide
ggccagccttggtggctcacgcctgtaatcccaacactttgggaggctgaggtggttggatcacttgaggtcaggagttcaagaccagcctggccaacatgagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctga

SEQ ID NO: 8418 - DNA, 2882 bp, Artificial Sequence
  Synthetic polypeptide
ggccagccttggtggctcacgcctgtaatcccaacactttgggaggctgaggtggttggatcacttgaggtcaggagttcaagaccagcctggccaacatgagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctga

SEQ ID NO: 8419 - DNA, 950 bp, Artificial Sequence
  Synthetic polypeptide
ctctgggaggatgaagttgagagaatacctaatattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactga

SEQ ID NO: 8420 - DNA, 1086 bp, Artificial Sequence
  Synthetic polypeptide
cttgctgttgtgtgacctggagaaggccttctctctccctgagcctcagtttccctatcatgacaaatggggaacccagtacttccttcccaaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaa

SEQ ID NO: 8421 - DNA, 777 bp, Artificial Sequence
  Synthetic polypeptide
cttgctgttgtgtgacctggagaaggccttctctctccctgagcctcagtttccctatcatgacaaatggggaacccagtacttccttcccaaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataa

SEQ ID NO: 8422 - DNA, 786 bp, Artificial Sequence
  Synthetic polypeptide
cttgctgttgtgtgacctggagaaggccttctctctccctgagcctcagtttccctatcatgacaaatggggaacccagtacttccttcccaaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataa

SEQ ID NO: 8423 - DNA, 249 bp, Artificial Sequence
  Synthetic polypeptide
cttgctgttgtgtgacctggagaaggccttctctctccctgagcctcagtttccctatcatgacaaatggggaacccagtacttccttcccaaggcaagcgcctccaggagtggtgctctgtgatcctgtgcttcagcctcatcgcccacaacctggtccatctcctgctgctggcccgctgggaggacacacccctcgtcatactcggtgttggctttcatccgacccttccgggagcaccacattga

SEQ ID NO: 8424 - DNA, 2419 bp, Artificial Sequence; identical to SEQ ID NO: 7455
  Synthetic polypeptide

SEQ ID NO: 8425 - DNA, 2668 bp, Artificial Sequence
  Synthetic polypeptide
ctctccctctccttcatctccgtctcccgctttccacggtctccccctctccctcgtctccgtctcccactttccacggtctccctctgttgccgaggctggactgtactgccgcgatctcggctcactgcaaccttcctgcctgattctcctgcctcagcctgccgagtgcctgggattgcaggcacgcgccgccacgcctgactggtttttgtgttttttggtggagacggggtttcgccatgttggccgggctggtctccagctcctgacctcgagtgatctgcccgcctcggcctcccgaggtgccgggattgcagacggagtctcgctcactcagtgctcaatgttgcccaggctggagtgcagtggcgtgatctcggctcgctacaacccccacctcccagccacctgccttggcctcccgaagtgctgagattgcagcctctgcccggccgccaccctgtctaggaagtgaggagcgtctctgcctggctgcccatcgtctgggatgtgaggagcccctctgcccggccgcccagtctgggaagtgaggagcgcctcttcccggccaccaccccgtctaggaagtgaggagcgtctctgcctggccgcccatcgtctgggatgtgaggagcccctctgcccagccacccagtctgggaagtgaggagtgcctcttcctggccgtcatcccgtctaggaagtgaggagcgtctctgcctggccgcccatcgtctgggatgtggggagcgcctctgcccggccgccaccctgtctgagaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 8426 - DNA, 2620 bp, Artificial Sequence
  Synthetic polypeptide
ctctccctctccttcatctccgtctcccgctttccacggtctccccctctccctcgtctccgtctcccactttccacggtctccctctgttgccgaggctggactgtactgccgcgatctcggctcactgcaaccttcctgcctgattctcctgcctcagcctgccgagtgcctgggattgcaggcacgcgccgccacgcctgactggtttttgtgttttttggtggagacggggtttcgccatgttggccgggctggtctccagctcctgacctcgagtgatctgcccgcctcggcctcccgaggtgccgggattgcagacggagtctcgctcactcagtgctcaatgttgcccaggctggagtgcagtggcgtgatctcggctcgctacaacccccacctcccagccacctgccttggcctcccgaagtgctgagattgcagcctctgcccggccgccaccctgtctaggaagtgaggagcgtctctgcctggctgcccatcgtctgggatgtgaggagcccctctgcccggccgcccagtctgggaagtgaggagcgcctcttcccggccaccaccccgtctaggaagtgaggagcgtctctgcctggccgcccatcgtctgggatgtgaggagcccctctgcccagccacccagtctgggaagtgaggagtgcctcttcctggccgtcatcccgtctaggaagtgaggagcgtctctgcctggccgcccatcgtctgggatgtggggagcgcctctgcccggccgccaccctgtctgagaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattag

SEQ ID NO: 8427 - DNA, 1806 bp, Artificial Sequence
  Synthetic polypeptide
ctctccctctccttcatctccgtctcccgctttccacggtctccccctctccctcgtctccgtctcccactttccacggtctccctctgttgccgaggctggactgtactgccgcgatctcggctcactgcaaccttcctgcctgattctcctgcctcagcctgccgagtgcctgggattgcaggcacgcgccgccacgcctgactggtttttgtgttttttggtggagacggggtttcgccatgttggccgggctggtctccagctcctgacctcgagtgatctgcccgcctcggcctcccgaggtgccgggattgcagacggagtctcgctcactcagtgctcaatgttgcccaggctggagtgcagtggcgtgatctcggctcgctacaacccccacctcccagccacctgccttggcctcccgaagtgctgagattgcagcctctgcccggccgccaccctgtctaggaagtgaggagcgtctctgcctggctgcccatcgtctgggatgtgaggagcccctctgcccggccgcccagtctgggaagtgaggagcgcctcttcccggccaccaccccgtctaggaagtgaggagcgtctctgcctggccgcccatcgtctgggatgtgaggagcccctctgcccagccacccagtctgggaagtgaggagtgcctcttcctggccgtcatcccgtctaggaagtgaggagcgtctctgcctggccgcccatcgtctgggatgtggggagcgcctctgcccggccgccaccctgtctgagaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgagggtgtggagcaccgttctggaatcccgttcgttgtttagcaagagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtagg

SEQ ID NO: 8428 - DNA, 1306 bp, Artificial Sequence
  Synthetic polypeptide
tttcttggttccctgactgggaagcgaggtgattaacagacaatcgaggcagcccttaggcagcttaggcccgccctgtggagcatccctgcgggggactccggccagcttgagcgacacggatcctgagagcactcccatgtaggcaattgccccagtggaatgcctcgccagagcagtgcatggcaggcccttgtggaggatcaacacagcggctgaacaccaggaaggacatggcacttggagtctggacatctgaaacttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 8429 - DNA, 641 bp, Artificial Sequence
  Synthetic polypeptide
tttcttggttccctgactgggaagcgaggtgattaacagacaatcgaggcagcccttaggcagcttaggcccgccctgtggagcatccctgcgggggactccggccagcttgagcgacacggatcctgagagcactcccatgtaggcaattgccccagtggaatgcctcgccagagcagtgcatggcaggcccttgtggaggatcaacacagcggctgaacaccaggaaggacatggcacttggagtctggacatctgaaacttggtgtttcggcatggagaccgaagtcccattgacacctttcccactgaccccataaaggaatcctcatggccacaaggatttggccaactcacccaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaacttt

SEQ ID NO: 8430 - DNA, 1207 bp, Artificial Sequence
  Synthetic polypeptide
tttcttggttccctgactgggaagcgaggtgattaacagacaatcgaggcagcccttaggcagcttaggcccgccctgtggagcatccctgcgggggactccggccagcttgagcgacacggatcctgagagcactcccatgtaggcaattgccccagtggaatgcctcgccagagcagtgcatggcaggcccttgtggaggatcaacacagcggctgaacaccaggaaggacatggcacttggagtctggacatctgaaacttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 8431 - DNA, 1402 bp, Artificial Sequence
  Synthetic polypeptide
tttcttggttccctgactgggaagcgaggtgattaacagacaatcgaggcagcccttaggcagcttaggcccgccctgtggagcatccctgcgggggactccggccagcttgagcgacacggatcctgagagcactcccatgtaggcaattgccccagtggaatgcctcgccagagcagtgcatggcaggcccttgtggaggatcaacacagcggctgaacaccaggaaggacatggcacttggagtctggacatctgaaacttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctga

SEQ ID NO: 8432 - DNA, 2636 bp, Artificial Sequence
  Synthetic polypeptide
gcctaaaggaacattttgacaccactaagcagaccaacatacacattatagaagtaccagaaggaaaatagaaaggagcagagagaatatatatttgatcaaataatggctgaaaatttcccaaatttgatgaaagacaggagtataaacatccaaacagctcaatgaactccaagtaagatgaactcagagaccctcaccaagacacattataatcaaactttcaaaagccaaagacaaactcttgaaagcatcaagagagaaatgactaaatgattcattacataaaggtatcctcagtaaaattatgaacgaatttctcatcagaaactttggaggccaggaggcagtgagccagtgtattcaaagtgctaaaaggaaaacaaaacaaaactgtcaaccaagcatcctatatctggcaaaactgtccttcaaaaggggcgagagattaagacattctcagaaaaacaaaagctaaggaaacttgttaccactggacctgccttgtaagaaatgctcaggagagtctgcaaggtgaaatgaaaggacattagattgtaacttgaagccatatgaagaaatatctcgataaagggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtgctgcgacaagagactttggacaaaaattga

SEQ ID NO: 8433 - DNA, 3776 bp, Artificial Sequence
  Synthetic polypeptide
gcctaaaggaacattttgacaccactaagcagaccaacatacacattatagaagtaccagaaggaaaatagaaaggagcagagagaatatatatttgatcaaataatggctgaaaatttcccaaatttgatgaaagacaggagtataaacatccaaacagctcaatgaactccaagtaagatgaactcagagaccctcaccaagacacattataatcaaactttcaaaagccaaagacaaactcttgaaagcatcaagagagaaatgactaaatgattcattacataaaggtatcctcagtaaaattatgaacgaatttctcatcagaaactttggaggccaggaggcagtgagccagtgtattcaaagtgctaaaaggaaaacaaaacaaaactgtcaaccaagcatcctatatctggcaaaactgtccttcaaaaggggcgagagattaagacattctcagaaaaacaaaagctaaggaaacttgttaccactggacctgccttgtaagaaatgctcaggagagtctgcaaggtgaaatgaaaggacattagattgtaacttgaagccatatgaagaaatatctcgataaagggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaa

SEQ ID NO: 8434 - DNA, 331 bp, Artificial Sequence
  Synthetic polypeptide
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgc

SEQ ID NO: 8435 - DNA, 1538 bp, Artificial Sequence
  Synthetic polypeptide
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctga

SEQ ID NO: 8436 - DNA, 884 bp, Artificial Sequence
  Synthetic polypeptide
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctga

SEQ ID NO: 8437 - DNA, 343 bp, Artificial Sequence
  Synthetic polypeptide
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgca

SEQ ID NO: 8438 - DNA, 401 bp, Artificial Sequence
  Synthetic polypeptide
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcgg

SEQ ID NO: 8439 - DNA, 1535 bp, Artificial Sequence
  Synthetic polypeptide
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaaggtaaagacacctgggcttga

SEQ ID NO: 8440 - DNA, 255 bp, Artificial Sequence
  Synthetic polypeptide
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctga

SEQ ID NO: 8441 - DNA, 88 bp, Artificial Sequence
  Synthetic polypeptide
cggcgcggcgcggagccctggaggtccaggtccctgaagacccagtggtggcactggtgggcaccgatgccaccctgtgctgctcctt

SEQ ID NO: 8442 - DNA, 429 bp, Artificial Sequence
  Synthetic polypeptide
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgct

SEQ ID NO: 8443 - DNA, 487 bp, Artificial Sequence
  Synthetic polypeptide
ggctgggtacagtggctaatgcctgtaatcccagcactttgggaggccgtgaagatctcaagatctcttgaggccagaagttcgagaccagcctggccaacatggcaaaacccccatctctactaaaaatacaaaaaattagccggacatggtgaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaa

SEQ ID NO: 8444 - DNA, 466 bp, Artificial Sequence
  Synthetic polypeptide
ggctgggtacagtggctaatgcctgtaatcccagcactttgggaggccgtgaagatctcaagatctcttgaggccagaagttcgagaccagcctggccaacatggcaaaacccccatctctactaaaaatacaaaaaattagccggacatggtgaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttag

SEQ ID NO: 8445 - DNA, 610 bp, Artificial Sequence
  Synthetic polypeptide
gtcaggtgcggtggctcatgcctttaatcctaacattttgggcggctgatgcgggtggatcacttgaggttgggagttcgagaccagcctggccaacctcgtctggccagtgaatggtggtgaaacctcgtctctactgaaaatacaaaaattagccaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaaca

SEQ ID NO: 8446 - DNA, 1047 bp, Artificial Sequence
  Synthetic polypeptide
gtcaggtgcggtggctcatgcctttaatcctaacattttgggcggctgatgcgggtggatcacttgaggttgggagttcgagaccagcctggccaacctcgtctggccagtgaatggtggtgaaacctcgtctctactgaaaatacaaaaattagccaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaa

SEQ ID NO: 8447 - DNA, 1005 bp, Artificial Sequence
  Synthetic polypeptide
gactgggcctggtggctcacgccggtaatcccagcactttgggaggccgaggcgggtggatcacgacatcaggagatcgagaccatcctggctaagacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattga

SEQ ID NO: 8448 - DNA, 942 bp, Artificial Sequence
  Synthetic polypeptide
gactgggcctggtggctcacgccggtaatcccagcactttgggaggccgaggcgggtggatcacgacatcaggagatcgagaccatcctggctaagacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagtagagatggggttttgccatgttggccagaatggttttgaactcctgacctcaagttatctacctgcctcagcctcccaaagtgccgagattatagccgtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattga

SEQ ID NO: 8449 - DNA, 559 bp, Artificial Sequence
  Synthetic polypeptide
gactgggcctggtggctcacgccggtaatcccagcactttgggaggccgaggcgggtggatcacgacatcaggagatcgagaccatcctggctaagacggtacaccagaggatcgcttcctggcagaatttgggagctgtttattgcagcactgttgtgccctctgatggtgaatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggag

SEQ ID NO: 8450 - DNA, 4522 bp, Artificial Sequence
  Synthetic polypeptide
ctccccctccctccctccccctctccctctccctctccccacggtctccctctgcctctctttccacggtctccctctgatgccgagccgaagctggactgtactgccgccatctctgctcactgcaacctccctgcctgattctcctgcctcaacctgccgagtgcctgcaattgcaggcacgcgccgccacgcctgactggttttcgtatttttttggtggagacggggtttcgctgtgttggccaggcaggtctctagctcctaaccgggagtaatctgccagcctcagcctcccgaggtgccgggattgcagatggagtcttgttcactcagtgctcaatgttgcccaggctggagtgcagcggcgtgatcttggctcactacaacctccacctcccagccgcctgccttggcctcccaaagtgccgagattgcagcctctgcctggccgccaccccatctgggaagtgaggagcgtctctgcctggccgcccatcgtctgggatgtgaggagcccctctgcccggctgcccagtctgggaagtgaggagcgcctcttcccggccgccatcccgtctaggaagtgaggagcgtctctgcccggccgcccatcgtctgagatgtggggagcgcctctgccccgccaccccatctgggatgtgaggagcgcctctgcccggccgcgaccccgtctgggagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaa

SEQ ID NO: 8451 - DNA, 278 bp, Artificial Sequence
  Synthetic polypeptide
agaaggcggactctggagccagaccgtctggatttgaacgcggattcggccacttactagttccgtgatcttgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtag

SEQ ID NO: 8452 - DNA, 136 bp, Artificial Sequence
  Synthetic polypeptide
agaaggcggactctggagccagaccgtctggatttgaacgcggattcggccacttactagttccgtgatcttgggaggacccagacagcgtgccccccatcgatgtcctctggatcaaaggggcccagggaggtga

SEQ ID NO: 8453 - DNA, 2265 bp, Artificial Sequence
  Synthetic polypeptide
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattag

SEQ ID NO: 8454 - DNA, 2121 bp, Artificial Sequence
  Synthetic polypeptide
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttccacctggagatcctttcacaccgagcggaagacagaaccagccacaggtttcatcgacggtga

SEQ ID NO: 8455 - DNA, 705 bp, Artificial Sequence
  Synthetic polypeptide
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggt

SEQ ID NO: 8456 - DNA, 595 bp, Artificial Sequence
  Synthetic polypeptide
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggag

SEQ ID NO: 8457 - DNA, 256 bp, Artificial Sequence
  Synthetic polypeptide
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccaggtga

SEQ ID NO: 8458 - DNA, 1007 bp, Artificial Sequence; identical to SEQ ID NO: 7489
  Synthetic polypeptide

SEQ ID NO: 8459 - DNA, 2261 bp, Artificial Sequence
  Synthetic polypeptide
ggccgggcgcggtggctcacggctgtaatcccagcactttgggaggccgaggcgggcggatcatgaggtcaggagatcgagaccatcctggctaacaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtga

SEQ ID NO: 8460 - DNA, 1211 bp, Artificial Sequence; identical to SEQ ID NO: 526
  Synthetic polypeptide

SEQ ID NO: 8461 - DNA, 1133 bp, Artificial Sequence; identical to SEQ ID NO: 527
  Synthetic polypeptide

SEQ ID NO: 8462 - DNA, 841 bp, Artificial Sequence; identical to SEQ ID NO: 529
  Synthetic polypeptide

SEQ ID NO: 8463 - DNA, 659 bp, Artificial Sequence; identical to SEQ ID NO: 530
  Synthetic polypeptide

SEQ ID NO: 8464 - DNA, 607 bp, Artificial Sequence
  Synthetic polypeptide
ggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacaggggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtga

SEQ ID NO: 8465 - DNA, 521 bp, Artificial Sequence
  Synthetic polypeptide
ggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacaggggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaag

SEQ ID NO: 8466 - DNA, 7177 bp, Artificial Sequence; identical to SEQ ID NO: 574
  Synthetic polypeptide

SEQ ID NO: 8467 - DNA, 7195 bp, Artificial Sequence; identical to SEQ ID NO: 575
  Synthetic polypeptide

SEQ ID NO: 8468 - DNA, 355 bp, Artificial Sequence
  Synthetic polypeptide
ccttgctattcagagcatggtttggagccaatggcatcagcatcacctatgaatgcagaatctcaggctgttccccagatctactgaaacagaatttttacttcaacaagatcttcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtag

SEQ ID NO: 8469 - DNA, 1227 bp, Artificial Sequence
  Synthetic polypeptide
ttatgataccacactgctcaaaaactcttagtgacttcttataatttataggttgcagttcaaatttgttagtcttggaatgtaaaggtctcttaaattgagccccagcctaccttcccagcattataggttactattatcctgctccagatccctagccaaactgggctcctccctgacctccagcagggatttccccttctacctcatgaaatctacagcaaccaacgctgcaaggaacatttaaattcttacttccttcaagaagtcttcccggatcacctccaactcaaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaa

SEQ ID NO: 8470 - DNA, 1215 bp, Artificial Sequence
  Synthetic polypeptide
ttatgataccacactgctcaaaaactcttagtgacttcttataatttataggttgcagttcaaatttgttagtcttggaatgtaaaggtctcttaaattgagccccagcctaccttcccagcattataggttactattatcctgctccagatccctagccaaactgggctcctccctgacctccagcagggatttccccttctacctcatgaaatctacagcaaccaacgctgcaaggaacatttaaattcttacttccttcaagaagtcttcccggatcacctccaactcaaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaa

SEQ ID NO: 8471 - DNA, 555 bp, Artificial Sequence
  Synthetic polypeptide
ttatgataccacactgctcaaaaactcttagtgacttcttataatttataggttgcagttcaaatttgttagtcttggaatgtaaaggtctcttaaattgagccccagcctaccttcccagcattataggttactattatcctgctccagatccctagccaaactgggctcctccctgacctccagcagggatttccccttctacctcatgaaatctacagcaaccaacgctgcaaggaacatttaaattcttacttccttcaagaagtcttcccggatcacctccaactcaaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagtaagttggatatatctcttatgtaaaaattattattag

SEQ ID NO: 8472 - DNA, 300 bp, Artificial Sequence
  Synthetic polypeptide
ttatgataccacactgctcaaaaactcttagtgacttcttataatttataggttgcagttcaaatttgttagtcttggaatgtaaaggtctcttaaattgagccccagcctaccttcccagcattataggttactattatcctgctccagatccctagccaaactgggctcctccctgacctccagcagggatttccccttctacctcatgaaatctacagcaaccaacgctgcaaggaacatttaaattcttacttccttcaagaagtcttcccggatcacctccaactcaaggaaaaa

SEQ ID NO: 8473 - DNA, 2662 bp, Artificial Sequence
  Synthetic polypeptide
ggaaggcagagcaagatggctgaatagaaccctccagcatttgtcccccaagcaagaacaccaacttgaacaactatccacacaagaaagcactttcagaagaactaaaactcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctga

SEQ ID NO: 8474 - DNA, 1822 bp, Artificial Sequence
  Synthetic polypeptide
ggaaggcagagcaagatggctgaatagaaccctccagcatttgtcccccaagcaagaacaccaacttgaacaactatccacacaagaaagcactttcagaagaactaaaactcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagcctgccgagtgcctgcgattgcaggcacgcgccaccacgcctgactggttttggtggagacggggtttcgctgtgttggccgggccggtctccagcccctaa

SEQ ID NO: 8475 - DNA, 2747 bp, Artificial Sequence
  Synthetic polypeptide
caggttgagcatccttaattcaaaaatccaaaattggaaatgctccagaatctgaaactttttgagcactgatacgttgctcagaggtcatgctcggaggaaatgctcgttggagcactttggattttggattttcagattgggaatccttaactgctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcaccgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactag

SEQ ID NO: 8476 - DNA, 814 bp, Artificial Sequence
  Synthetic polypeptide
ctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggagacatgtagactgccaaagtgtatgggatgctttcaagggtgcatttatttcaaaacatccttgcaacattactgaagaagactatcagccactaatgaagttgggaactcagaccgtaccttgcaacaagaaataa

SEQ ID NO: 8477 - DNA, 1348 bp, Artificial Sequence
  Synthetic polypeptide
ctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctga

SEQ ID NO: 8478 - DNA, 658 bp, Artificial Sequence; identical to SEQ ID NO: 7189
  Synthetic polypeptide

SEQ ID NO: 8479 - DNA, 1999 bp, Artificial Sequence; identical to SEQ ID NO: 7190
  Synthetic polypeptide

SEQ ID NO: 8480 - DNA, 671 bp, Artificial Sequence; identical to SEQ ID NO: 7191
  Synthetic polypeptide

SEQ ID NO: 8481 - DNA, 739 bp, Artificial Sequence; identical to SEQ ID NO: 7192
  Synthetic polypeptide

SEQ ID NO: 8482 - DNA, 1392 bp, Artificial Sequence; identical to SEQ ID NO: 6782
  Synthetic polypeptide

SEQ ID NO: 8483 - DNA, 933 bp, Artificial Sequence; identical to SEQ ID NO: 6783
  Synthetic polypeptide

SEQ ID NO: 8484 - DNA, 981 bp, Artificial Sequence; identical to SEQ ID NO: 6784
  Synthetic polypeptide

SEQ ID NO: 8485 - DNA, 2157 bp, Artificial Sequence
  Synthetic polypeptide
ctctccctctccccctccccctccccctctccctctccccacggtctccctctccctctctttccagggtctccctctgatgcccagccgaagctggactgtactgctgccatctcggctcactgcaacctccccgcctgattctcctgcctcagcctgcagagtgcctgccattgcaggcacgcgccgccacgcctgactggttttcgtatttttttggtggagatggggtttcgctgtgttggccgggctagtctccagctcctaaccgcgagtgatccgccagcctcggcctccggaggtgccgggattgcagacggtgtctggttcaatcagtgctcaatggtgcccaggctggaatgcagtggcgtgatctcggctcgctacaacctccacctcccagccacctgccttggcctcccaaagtgccgagagtgcagcctctgcccggccgccaccccgtctgggaagtgaggagcgtctctgcctggccgcctatcgtctgggacgtgaggagcccctctgcgtggctgcccagtctggaaagtgaggagcgtctctgcccggtcgccatcccatctaggaagtgaggagcgcctcttcccggccgccatcccatctaggaagtgaggagcatctctgcctggccgcccttcttctgagatgtggggagcgcctttgccccaccgccctgtctgggatgtgaggagcgcctctgccaggccgcgaccccgtctgggaggtgaggagcgtctctgcccagccgccccgtctgagaagggaggagaccctccgcccggcaaccgccccgtctcagaagtgaggagcccttccacccggcagtcaccccgtctgggacgtgaggagcgtctccgccaggcagccaccccgtccgggagggaggtgggggtcagcccccaccaggccagccgccccgtccgggagggaggtggggggggatcagccccctgcccggccagccgccccgtccgggaggaaggtgggggggccagccccccgcccggctagccgccccgtctgggaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattga

SEQ ID NO: 8486 - DNA, 2397 bp, Artificial Sequence
  Synthetic polypeptide
ggccgagtgcggtggctcatgcctgtaatcccagcactttgggaggccgagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtag

SEQ ID NO: 8487 - DNA, 2412 bp, Artificial Sequence
  Synthetic polypeptide
ggccgagtgcggtggctcatgcctgtaatcccagcactttgggaggccgagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacccctgctcccccagcggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtag

SEQ ID NO: 8488 - DNA, 55 bp, Artificial Sequence
  Synthetic polypeptide
ggccgagtgcggtggctcatgcctgtaatcccagcactttgggaggccgagataa

SEQ ID NO: 8489 - DNA, 2328 bp, Artificial Sequence
  Synthetic polypeptide
ggccgagtgcggtggctcatgcctgtaatcccagcactttgggaggccgagataaatttccgctgtaagccgtccttccgtgaatcaggctccaggaatgtccgcgagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtag

SEQ ID NO: 8490 - DNA, 249 bp, Artificial Sequence
  Synthetic polypeptide
ggccgagtgcggtggctcatgcctgtaatcccagcactttgggaggccgagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggca

SEQ ID NO: 8491 - DNA, 1512 bp, Artificial Sequence
  Synthetic polypeptide
tatggtaggctgaataatggtcccctcccatcccaagatgtccatatcctaaccgcccctctttgcctgtgagtttccttacacagcaacagggaccttgccatgtaaatcaaagatcttaagttggggagattatgctcattgtctgggtaaatctaatgtcatcaaaggatccttataagaaggaggcagaagggtcagagaaaggagatgtgaggataatggaagcagaagtcaggagagagggaacagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaa

SEQ ID NO: 8492 - DNA, 605 bp, Artificial Sequence
  Synthetic polypeptide
tatggtaggctgaataatggtcccctcccatcccaagatgtccatatcctaaccgcccctctttgcctgtgagtttccttacacagcaacagggaccttgccatgtaaatcaaagatcttaagttggggagattatgctcattgtctgggtaaatctaatgtcatcaaaggatccttataagaaggaggcagaagggtcagagaaaggagatgtgaggataatggaagcagaagtcaggagagagggaacagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagct

SEQ ID NO: 8493 - DNA, 285 bp, Artificial Sequence
  Synthetic polypeptide
tatggtaggctgaataatggtcccctcccatcccaagatgtccatatcctaaccgcccctctttgcctgtgagtttccttacacagcaacagggaccttgccatgtaaatcaaagatcttaagttggggagattatgctcattgtctgggtaaatctaatgtcatcaaaggatccttataagaaggaggcagaagggtcagagaaaggagatgtgaggataatggaagcagaagtcaggagagagggaacagatcaagaccctcaacaataagtttgcctccttc

SEQ ID NO: 8494 - DNA, 223 bp, Artificial Sequence
  Synthetic polypeptide
agtcagcgacagagctggggcccgcgtctcctgactctgcactgacttctcacatggcctcatgcgaacgccttcagctccctcggcctccgcttcctctgtgatgtggggatgatgacaattcccaccacaaaagtctatcaaaaggaaacttcctttcctcaactgggatgcctttcctaagctgaaaggactgaggagcgcaactcctgatgcccagtga

SEQ ID NO: 8495 - DNA, 1584 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8496 - DNA, 1242 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8497 - DNA, 1539 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8498 - DNA, 1623 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8499 - DNA, 1677 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacagggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8500 - DNA, 1632 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacagggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8501 - DNA, 555 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtaagtag

SEQ ID NO: 8502 - DNA, 401 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttca

SEQ ID NO: 8503 - DNA, 166 bp, Artificial Sequence
  Synthetic polypeptide
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcga

SEQ ID NO: 8504 - DNA, 701 bp, Artificial Sequence; identical to SEQ ID NO: 658
  Synthetic polypeptide

SEQ ID NO: 8505 - DNA, 809 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8506 - DNA, 809 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8507 - DNA, 8628 bp, Artificial Sequence
  Synthetic polypeptide
ctttcccaccggagtgagccctgagttcagggcctagtgtgatctactcagcactgtatccctggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtggtagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctga

SEQ ID NO: 8508 - DNA, 8628 bp, Artificial Sequence
  Synthetic polypeptide
ctttcccaccggagtgagccctgagttcagggcctagtgtgatctactcagcactgtatccctggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtgacagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctga

SEQ ID NO: 8509 - DNA, 240 bp, Artificial Sequence
  Synthetic polypeptide
ctttcccaccggagtgagccctgagttcagggcctagtgtgatctactcagcactgtatccctggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccg

SEQ ID NO: 8510 - DNA, 336 bp, Artificial Sequence
  Synthetic polypeptide
ctttcccaccggagtgagccctgagttcagggcctagtgtgatctactcagcactgtatccctggcttctcccacctgcccagtgggctgtacccatcctacctccacctgaaccacctggagccccccagcagtgggagccccctcctcagccagctgggtcagcccagcattttcgatacccagaaaggtcaggggccaggaggaggtaagactggagtccggggttgggggtggcacaggggccttctgagaggcttctggggcctttggcagcatccaggtagcccccagctctgtccaggatgctggctttttttttttttttttttttga

SEQ ID NO: 8511 - DNA, 2433 bp, Artificial Sequence
  Synthetic polypeptide
ggcagggtgcggtggctcacacctgtaatcccagcactttgggaggccaaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtag

SEQ ID NO: 8512 - DNA, 380 bp, Artificial Sequence
  Synthetic polypeptide
ggcagggtgcggtggctcacacctgtaatcccagcactttgggaggccaaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaa

SEQ ID NO: 8513 - DNA, 257 bp, Artificial Sequence
  Synthetic polypeptide
ggcagggtgcggtggctcacacctgtaatcccagcactttgggaggccaaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagca

SEQ ID NO: 8514 - DNA, 250 bp, Artificial Sequence
  Synthetic polypeptide
ggcagggtgcggtggctcacacctgtaatcccagcactttgggaggccaaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcacca

SEQ ID NO: 8515 - DNA, 1967 bp, Artificial Sequence; identical to SEQ ID NO: 7428
  Synthetic polypeptide

SEQ ID NO: 8516 - DNA, 1142 bp, Artificial Sequence; identical to SEQ ID NO: 7429
  Synthetic polypeptide

SEQ ID NO: 8517 - DNA, 328 bp, Artificial Sequence
  Synthetic polypeptide
ggccgggcgcggtggctcacgcctgtaatcccagcactttgggaggccaagagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccatt

SEQ ID NO: 8518 - DNA, 1497 bp, Artificial Sequence
  Synthetic polypeptide
ggccgggcgcggtggctcacgcctgtaatcccagcactttgggaggccaagagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtga

SEQ ID NO: 8519 - DNA, 76 bp, Artificial Sequence
  Synthetic polypeptide
ggccgggcgcggtggctcacgcctgtaatcccagcactttgggaggccaagagatggacagagacgtatgtgcgtt

SEQ ID NO: 8520 - DNA, 1477 bp, Artificial Sequence; identical to SEQ ID NO: 509
  Synthetic polypeptide

SEQ ID NO: 8521 - DNA, 1369 bp, Artificial Sequence; identical to SEQ ID NO: 510
  Synthetic polypeptide

SEQ ID NO: 8522 - DNA, 709 bp, Artificial Sequence; identical to SEQ ID NO: 511
  Synthetic polypeptide

SEQ ID NO: 8523 - DNA, 1681 bp, Artificial Sequence
  Synthetic polypeptide
gaaagagcactggacttggagtctaaacacaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctga

SEQ ID NO: 8524 - DNA, 3744 bp, Artificial Sequence
  Synthetic polypeptide
agaaggacctccagccttttaccggggagactatgcactggggaagaggctgtaatcagagcctttggggacaactggacctggctctgagctgtcattgatcccaggagacccacgccactgcaggcctcctgtcagagtcagagtcaggccaggtcgagtcaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctcatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctga

SEQ ID NO: 8525 - DNA, 795 bp, Artificial Sequence
  Synthetic polypeptide
cggggcggggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaa

SEQ ID NO: 8526 - DNA, 194 bp, Artificial Sequence
  Synthetic polypeptide
cggggcggggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctc

SEQ ID NO: 8527 - DNA, 462 bp, Artificial Sequence
  Synthetic polypeptide
cggggcggggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtgatgaccgttcattaa

SEQ ID NO: 8528 - DNA, 66 bp, Artificial Sequence
  Synthetic polypeptide
cggggcggggattggaatacttttctgctacggttcaatgatttggacttgtgtgtatcagagaat

SEQ ID NO: 8529 - DNA, 268 bp, Artificial Sequence
  Synthetic polypeptide
cggggcggggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaacca

SEQ ID NO: 8530 - DNA, 132 bp, Artificial Sequence
  Synthetic polypeptide
cggggcggggattggaatacttttctgctacggttcaatgatttggacttgtgtgtatcagagaatgaaaccctcaagcatctcacaaacgacaccacaactccggaaagtacaatgaccagcgggcaggcc

SEQ ID NO: 8531 - DNA, 939 bp, Artificial Sequence
  Synthetic polypeptide
cattggcatttttcttgtttctcaaatgttccaggcattttctgctgcttagggcattttgttcttgatgtttgctttctctggaatgctatttcaccagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaa

SEQ ID NO: 8532 - DNA, 876 bp, Artificial Sequence
  Synthetic polypeptide
cattggcatttttcttgtttctcaaatgttccaggcattttctgctgcttagggcattttgttcttgatgtttgctttctctggaatgctatttcaccagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaa

SEQ ID NO: 8533 - DNA, 877 bp, Artificial Sequence
  Synthetic polypeptide
cattggcatttttcttgtttctcaaatgttccaggcattttctgctgcttagggcattttgttcttgatgtttgctttctctggaatgctatttcaccagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctg

SEQ ID NO: 8534 - DNA, 137 bp, Artificial Sequence
  Synthetic polypeptide
ggccgggcgcggggctcaggcctgtcatcccagcactttaggtggctaaggctggactgggatcagatgggaagcggaagctcatcatgaccagaaactgtttccctacagagagcacttggagatggcaaagctga

SEQ ID NO: 8535 - DNA, 1443 bp, Artificial Sequence; identical to SEQ ID NO: 6760
  Synthetic polypeptide

SEQ ID NO: 8536 - DNA, 984 bp, Artificial Sequence; identical to SEQ ID NO: 6761
  Synthetic polypeptide

SEQ ID NO: 8537 - DNA, 1032 bp, Artificial Sequence; identical to SEQ ID NO: 6762
  Synthetic polypeptide

SEQ ID NO: 8538 - DNA, 477 bp, Artificial Sequence
  Synthetic polypeptide
ggccgggcgcggtggctcacgcctgtaatcctagcactctgggaggccgaggcgggcggatcacgaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 8539 - DNA, 730 bp, Artificial Sequence
  Synthetic polypeptide
agaggagagcatgtactgggggagagcctgctggattggcacgagacaacttgggcgtgagctccagctccaccactaactagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatag

SEQ ID NO: 8540 - DNA, 727 bp, Artificial Sequence
  Synthetic polypeptide
agaggagagcatgtactgggggagagcctgctggattggcacgagacaacttgggcgtgagctccagctccaccactaactagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctag

SEQ ID NO: 8541 - DNA, 424 bp, Artificial Sequence
  Synthetic polypeptide
ctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccatagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttag

SEQ ID NO: 8542 - DNA, 1171 bp, Artificial Sequence
  Synthetic polypeptide
ctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccatagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctga

SEQ ID NO: 8543 - DNA, 1533 bp, Artificial Sequence
  Synthetic polypeptide
ggcatcagatgttcaaagcgagggaagagagtgaggtgaagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaa

SEQ ID NO: 8544 - DNA, 561 bp, Artificial Sequence; identical to SEQ ID NO: 6592
  Synthetic polypeptide

SEQ ID NO: 8545 - DNA, 196 bp, Artificial Sequence; identical to SEQ ID NO: 6593
  Synthetic polypeptide

SEQ ID NO: 8546 - DNA, 423 bp, Artificial Sequence; identical to SEQ ID NO: 6594
  Synthetic polypeptide

SEQ ID NO: 8547 - DNA, 352 bp, Artificial Sequence
  Synthetic polypeptide
gggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtag

SEQ ID NO: 8548 - DNA, 274 bp, Artificial Sequence
  Synthetic polypeptide
gggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtg

SEQ ID NO: 8549 - DNA, 246 bp, Artificial Sequence
  Synthetic polypeptide
gggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccag

SEQ ID NO: 8550 - DNA, 340 bp, Artificial Sequence
  Synthetic polypeptide
tcagcatcacctgggagctgggtagaaagaaatgcagattctcagtccccttccgagtcatgaggggaatctttgctgatgaactccaggtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattga

SEQ ID NO: 8551 - DNA, 7988 bp, Artificial Sequence
  Synthetic polypeptide
gagggaggagccaagatggccgaataggaacagctccggtctacagctcccagcgtgagcgacgaagaagacgggtgatttctgcatttccatctgaggtagaagtgctgtctgtggtcgctcagcagatcctcagcatccaacaagccatcattcggaagctaaagacattcatctttgaagggactgagctctctctgaacccaacctgcgctgtgttcatcaccatgaaccccgggtatgctggcagggctgaactgcccgacaatctcaaggccttgttccggacagtggccatgatggtcccagattacgccctcattggagaaatctccctctactccatggggtttctggactccagaagtctcgcccagaagatcgttgcgacctaccgcctgtgctcggaacaactgtcctctcagcatcactatgactacggtatgcgcgctgtcaagtctgtgcttactgccgcaggaaacctgaagctcaagtatccagaggagaatgaaagtgtcctgctgctccgggcattgcttgatgtcaatctggccaagttcttagcgcaagatgtccctctgtttcagggaattatatctgatttatttcctggagttgttcttccaaagccagactatgaagtttttctgaaagtgctgaatgataacatcaaaaagatgaaactccagccagtaccttggtttatagggaaaattatccagatctacgaaatgatgctggtgagacatggctatatgattgtaggagaccccatgggcggcaagacctctgcttataaagtgttggctgcagctctcggcgatttacacgcagccaatcagatggaggagtttgctgtggagtacaagatcatcaaccccaaggctatcacgatggggcagctgtatgggtgctttgaccaagtgagccacgagtggatggatggtgtccttgccaatgctttccgggagcaagcgtcttcactctctgatgatcgcaagtggattatatttgatgggccagtggatgctatttggattgaaaatatgaacactgttctggatgacaataaaaagctgtgtctcatgagtggggaaattatccagatgaactccaagatgagcctgatcttcgagcccgccgacctcgagcaagcctctccagccactgtgagcaggtgtgggatgatctacatggagccccatcaactaggctggaagcccctgaaggattcctacatggacaccctgccctccagtctcaccaaggagcacaaagaattggtcaatgacatgttcatgtggcttgtccagccctgcctggaatttggtcgccttcattgtaaatttgttgtccagacatctcccatccaccttgccttctcaatgatgagactgtactcttctctgcttgatgaaatcagggcagtagaagaggaggaaatggaattaggtgaaggcctgtcaagtcaacagatctttctctggctccaaggactgtttctcttttccttggtgtggaccgtggctggcaccatcaacgcagacagcagaaagaaatttgatgtgtttttccgcaacctgatcatgggcatggatgataaccacccaaggcccaaaagcgtcaaactcaccaaaaacaacatctttccagaaagaggaagcatctatgatttttattttatcaaacaagctagtggacattgggaaacgtggacacagtatatcaccaaagaggaggaaaaagttccagctggtgcaaaggtctcagaactcatcatccccacaatggagacagcccggcagtccttcttcttgaaaacctacttagaccatgagattccaatgctgttcgtgggtcccacaggcactggcaaatcagccatcaccaacaacttccttctccaccttcccaaaaatacgtacctacccaactgcatcaatttctctgccagaacctcagccaatcagacccaggatatcatcatgtccaagctggatcgacgacggaagggccttttcgggcctcccatagggaagaaagcagtggtgtttgtggatgacctcaacatgccagccaaagaggtgtatggggcccagccacccatcgagctcctgaggcagtggattgaccatggttactggtttgacaaaaaagacacaaccaggctggacatcgtggacatgctgctcgtgacagccatggggccccccgggggaggaaggaatgacattactggacgattcactcgccatctgaatatcatttccatcaatgcctttgaggatgacattttaaccaagattttcagttcgattgttgactggcacttcgggaaagggtttgatgtgatgtttttaaggtacggaaagatgctggtccaagctactaagacaatttatagagatgcagtggagaacttcttgccaactccctcgaagtcacattacgtctttaacctgcgggacttctcacgagtgattcaaggggtcctgctgtgccctcacacacacctgcaggatgtagaaaaatgtatccggctttggatccatgaggtttatcgggtcttctatgatcgtctgattgacaaggaggacagacaggtctttttcaacatggtgaaggaaaccacctccaattgcttcaagcagaccatagagaaggtgcttatccacttgtcacccactggaaagatagtcgatgataacattcgaagcctcttctttggagattatttcaagccagaaagtgaccaaaaaatctacgatgagatcactgacctgaaacagctgactgtggtcatggagcactatctggaagaattcaacaacatcagcaaggcccccatgtccctggtcatgttcaggtttgccattgagcacatctctaggatctgccgtgtcctgaagcaggacaaaggccacctgctcctggtgggcatagggggcagcgggcggcaaagtgccgccaaactgtccacattcatgaacgcatacgagctataccagattgagatcaccaagaactacgcaggcaatgactggcgagaagatcttaagaagatcatactgcaggtcggtgtggccaccaagagcaccgtgttcctcttcgccgacaaccagatcaaggatgaatcattcgtggaggacatcaacatgcttctgaacacaggtgacgtgcctaacatcttccctgctgacgagaaggctgacatcgtggagaagatgcagactgcagccaggacccaaggagagaaggttgaagtcactcctctttctatgtataacttctttattgagagggtaattaacaaaatctccttttcattagccatgagtccaataggggatgccttcaggaaccgcctgcggatgttcccttcgctgatcaattgctgtacgattgattggttccagtcctggcccacagatgccctagagttggtggctaacaaatttctagaggatgtggagcttgatgacaacattcgggtagaggtcgtgtccatgtgcaaatatttccaagagagcgtcaagaagctgtcactcgattattacaacaaacttcgaagacacaactatgttacccccacctcctaccttgaattgattctaaccttcaagacgctcctgaatagcaagaggcaagaggtggctatgatgaggaaccgctacctgacaggcttgcagaaactcgactttgcagcttctcaggtagcggttatgcaaagagaactgacagctcttcaacctcaactcatcctcacctccgaggaaactgccaagatgatggtgaaaattgaagcggagacgagagaagctgatggaaagaaacttctggtgcaggcagatgaaaaagaagccaatgttgctgctgccattgcccaaggaatcaagaacgaatgtgagggggacctagctgaggcaatgcctgcactcgaggctgcactagctgctctggacaccctgaacccggccgacatctcgctggtgaagtcgatgcagaacccaccaggccctgtcaaactggtcatggagagcatctgcatcatgaaagggatgaagccagagaggaagccagaccccagtggctccggtaagatgatagaagattactggggggtatccaaaaagattcttggggatctgaaattcttggagagtcttaagacatatgacaaagacaacatccccccactgaccatgaagcggatccgggaaaggtttatcaatcacccggaattccagccagctgtcattaaaaatgtatcgtcggcctgcgagggtctgtgcaagtgggtgagggccatggaggtgtacgatcgcgtggccaaggtggtggctcccaaacgggagcgactgagggaggcagaggggaagctggctgcacagatgcagaagctgaaccagaaaagagcagagctgaagctggtggtagatcggctccaggccctgaatgacgactttgaagagatgaacaccaagaaaaaggacttggaggaaaacattgaaatctgctcccaaaagctggtcagggcagagaaactgatcagtggtcttgggggagagaaggacagatggaccgaagctgcccgacagctggggatccgctatactaatctgactggtgacgtgttgctgtcctcaggaactgtggcttacctgggcgcttttacagtggattatcgggtccagtgccaaaatcagtggttggctgaatgtaaggacaaggtcatccctggcttcagtgacttcagtctcagccacacgttaggggatcccataaaaatccgtgcctggcagattgctgggcttcccgttgactccttctccatcgacaatggcatcattgtatccaattccagacgctgggccttaatgattgaccctcacgggcaggccaataaatggattaagaacatggagaaggcgaataaactggctgtcatcaagttctctgatagcaactacatgaggatgctggaaaacgcgctgcagttaggcacccctgtcttgattgaaaacattggagaagagctggatgcttctatcgaacctatcttgctcaaggcaacattcaaacagcaaggagttgagtacatgaggctgggtgaaaacatcattgaatattccagggattttaagttatacatcacaacccgtttgaggaatccacattacctcccagaagttgccgtgaaggtctgtctcctcaacttcatgatcacccccttgggtctccaagatcaactccttggcatcgtggctgcgaaggagaagccagagctggaagagaaaaagaaccagttgattgtggaaagtgccaagaacaagaagcatctcaaggaaattgaagataagatcttggaggttctctccatgtccaagggtaacatcctggaggatgaaaccgccatcaaagttctgtcctcctccaaagtgctatctgaagagatctcagagaaacagaaagttgcttccatgacagaaacgcagattgacgagactcggatgggctacaagccagtggctgtgcattctgccaccatcttcttttgtatctcggacctggccaacatcgagccgatgtaccagtactccctgacttggttcataaatctctacatgcattccttgacccacagcacgaagagcgaggaactgaatctgcgcatcaagtacatcattgaccatttcaccctgagcatctacaacaacgtgtgccgttctctgtttgagaaggacaagctactcttctctctcctcctgaccatcggcatcatgaaacagaagaaggaaattacggaggaggtgtggtacttccttctcactggaggcatcgcactggataacccctaccccaatccagctccccaatggctgtctgagaaggcatgggcagagattgtccgtgcatctgccttacccaaactgcatggcctgatggagcatttggaacagaacctgggtgaatggaagctgatctatgactcggcctggccccatgaggagcaactccctgggtcttggaagttctctcaaggattggagaagatggtgatccttcgatgtttgcggcctgacaaaatggtgccagcggtccgggagttcattgctgaacatatgggaaagctgtatatcgaagcccctacgttcgatctccagggatcctacaatgattccagctgctgtgcgcctttgatttttgtgttgtctccaagtgcagacccaatggcaggcctgctgaagtttgctgatgatcttggtatgggaggtaccagaacacagaccatctcccttggccaaggccaaggccctattgctgccaaaatgatcaacaatgccatcaaagacgggacctgggtggtcttacagaactgccacctggccgcaagctggatgcctaccctggagaagatttgtgaggaggtgattgttcctgagagcaccaatgccagattcagactctggctaaccagctatccatcagagaagtttccagtcagcattctccagaatggaatcaaaatgaccaatgagccccccaaagggctccgggccaacctgttgcgctcctacctcaatgaccccatctcagatcctgtgttcttccaaagctgtgcaaaggcggtgatgtggcaaaagatgttatttggcctttgtttcttccacgccgttgttcaagagagaagaaacttcggccccctagggtggaatattccctatgaattcaacgaatctgacctgaggattagtatgtggcagatccagatgtttctcaatgactacaaggaggtgccctttgatgctctgacctacctgacaggggaatgtaattacggaggcagagtgactgatgacaaagaccggcgtctcctgctgtcacttctgtccatgttctactgtaaggaaattgaggaggactattactccctcgctcctggagacacttactacatccctcctcatggctcctaccagtcctatatcgactatctcaggaatctccccatcacagcccacccagaagtgttcggcctccatgagaacgcagacatcaccaaagacaaccaggaaaccaaccagctgtttgagggggtcctgctgaccctccctagacagtcaggaggaagtggcaagtcccctcaggaagtggttgaggagttggcacaagacattctctccaagcttcccagagactttgacctggaagaggtcatgaagttgtaccccgtggtctatgaagaatccatgaataccgtcctaaggcaggagctcatcagattcaacaggctgaccaaagtggttcggaggagcctcatcaatcttggccgagccatcaaaggacaggtcctgatgtcctcggagctagaggaagtctttaacagcatgcttgtgggtaaagtgccagccatgtgggcagccaagtcttacccatcactgaagcctctggggggctacgtggctgacctgctggcccgcctgaccttcttccaggaatggattgacaaggggccccctgtggtattttggatctctggattctacttcacacagtcttttttgactggcgtctctcaaaattatgcccggaaatataccatccccattgaccacattggatttgagtttgaggtaaccccacaagaaacagtgatggagaataaccccgaagatggggcctacatcaaagggctcttcttagaaggtgcccgttgggacaggaaaacgatgcagattggggaatctctccccaaaatcctctatgacccactgcccatcatttggctgaaacctggggagagcgcaatgtttctgcatcaggacatctatgtgtgtccagtctacaaaacaagtgcccgcagaggaaccctctccaccacaggccactctaccaactatgtcctctccattgagcttccaacagacatgccccagaagcactggataaaccgaggggtggcctcactgtgccagctggataactga

SEQ ID NO: 8552 - DNA, 1301 bp, Artificial Sequence
  Synthetic polypeptide
gagggaggagccaagatggccgaataggaacagctccggtctacagctcccagcgtgagcgacgaagaagacgggtgatttctgcatttccatctgaggtagaagtgctgtctgtggtcgctcagcagatcctcagcatccaacaagccatcattcggaagctaaagacattcatctttgaagggactgagctctctctgaacccaacctgcgctgtgttcatcaccatgaaccccgggtatgctggcagggctgaactgcccgacaatctcaaggccttgttccggacagtggccatgatggtcccagattacgccctcattggagaaatctccctctactccatggggtttctggactccagaagtctcgcccagaagatcgttgcgacctaccgcctgtgctcggaacaactgtcctctcagcatcactatgactacggtatgcgcgctgtcaagtctgtgcttactgccgcaggaaacctgaagctcaagtatccagaggagaatgaaagtgtcctgctgctccgggcattgcttgatgtcaatctggccaagttcttagcgcaagatgtccctctgtttcagggaattatatctgatttatttcctggagttgttcttccaaagccagactatgaagtttttctgaaagtgctgaatgataacatcaaaaagatgaaactccagccagtaccttggtttatagggaaaattatccagatctacgaaatgatgctggtgagacatggctatatgattgtaggagaccccatgggcggcaagacctctgcttataaagtgttggctgcagctctcggcgatttacacgcagccaatcagatggaggagtttgctgtggagtacaagatcatcaaccccaaggctatcacgatggggcagctgtatgggtgctttgaccaagtgagccacgagtggatggatggtgtccttgccaatgctttccgggagcaagcgtcttcactctctgatgatcgcaagtggattatatttgatgggccagtggatgctatttggattgaaaatatgaacactgttctggatgacaataaaaagctgtgtctcatgagtggggaaattatccagatgaactccaagatgagcctgatcttcgagcccgccgacctcgagcaagcctctccagccactgtgagcaggtgtgggatgatctacatggagccccatcaactaggctggaagcccctgaaggattcctacatggacaccctgccctccagtctcaccaaggagcacaaagaattgatgaaatcagggcagtag

SEQ ID NO: 8553 - DNA, 586 bp, Artificial Sequence; identical to SEQ ID NO: 6809
  Synthetic polypeptide

SEQ ID NO: 8554 - DNA, 1067 bp, Artificial Sequence
  Synthetic polypeptide
ccagagtccaactgcttgggttaatccccattctgctcttacctgtggtgggcctcagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattga

SEQ ID NO: 8555 - DNA, 459 bp, Artificial Sequence
  Synthetic polypeptide
tgacctttgaccaataaggatttgaattgcgcgggtccacttatatgcggattttttttcaaccaaacgcgaccagtatttacgggatgtgccgccccgcgtataaggagggcaggctcttcctataagcggattctgcaaggctgactgcgggacgttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataa

SEQ ID NO: 8556 - DNA, 1731 bp, Artificial Sequence; identical to SEQ ID NO: 6691
  Synthetic polypeptide

SEQ ID NO: 8557 - DNA, 2019 bp, Artificial Sequence; identical to SEQ ID NO: 6692
  Synthetic polypeptide

SEQ ID NO: 8558 - DNA, 2043 bp, Artificial Sequence; identical to SEQ ID NO: 6693
  Synthetic polypeptide

SEQ ID NO: 8559 - DNA, 554 bp, Artificial Sequence; identical to SEQ ID NO: 6694
  Synthetic polypeptide

SEQ ID NO: 8560 - DNA, 571 bp, Artificial Sequence
  Synthetic polypeptide
gaaggaggagccaagatggccgaataggaacagctctggtctacagctcccagcgtgagcgacgcagaagatgggtgatttctgcatttccatctgagacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacgggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtga

SEQ ID NO: 8561 - DNA, 1456 bp, Artificial Sequence
  Synthetic polypeptide
gtgggaccttgggcaagtcagttttaagtgtgaccttggagatacctcatcatatcacacaaaggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8562 - DNA, 1508 bp, Artificial Sequence
  Synthetic polypeptide
gtgggaccttgggcaagtcagttttaagtgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8563 - DNA, 4806 bp, Artificial Sequence
  Synthetic polypeptide
aaaattaaataaacagagaaggctgatataaaaaatggccaagtgacatgaacattcacttcacttaataacagacaacataaaatggcccttaagtcctctgtaaaaatgtttaatctcattaatgatcaaggaaacacaaattaaaactatactaggatatgaattcttagctgtcaagttggcagcaatcaaaaagctagacaacacactctgaaggttaggcggtggggaagtaggtatacctgtacattgctagtagtaatgcagtgtggtaaaaactgttttgggggaggaatttttcaagatgtgacaaaatttaacacgtatttgcttttttatttagaattctctcttgtcagaatttactctgaagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggaaagttgtggagcagaagtttaaagttggcctacacacttcttaataaactggggaccaaaaatgaacctgtgttaaaacctggagacagggtagccctggtttaccccaacaatgatccagtcatgtttatggtggctttctatggatgcctcctggcagaagtgattccagtgcctatagaggtacctcttaccagaaaggatgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgagtataaaacaagcaaagaagggagtgtaatgggagttacagtatcccggcttgcaatgttgtctcactgccaagctctgtcgcaggcctgcaattattctgaaggggaaacaatagtaaatgtcttagactttaagaaggatgctgggctgtggcacggcatgtttgcgaatgtaatgaataagatgcacacaatcagcgtaccctactctgttatgaaaacctgtcctctctcttgggtccaaagagtacatgctcacaaagccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaattgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaa

SEQ ID NO: 8564 - DNA, 1093 bp, Artificial Sequence; identical to SEQ ID NO: 7796
  Synthetic polypeptide

SEQ ID NO: 8565 - DNA, 2322 bp, Artificial Sequence; identical to SEQ ID NO: 7493
  Synthetic polypeptide

SEQ ID NO: 8566 - DNA, 1698 bp, Artificial Sequence; identical to SEQ ID NO: 7494
  Synthetic polypeptide

SEQ ID NO: 8567 - DNA, 1490 bp, Artificial Sequence; identical to SEQ ID NO: 7414
  Synthetic polypeptide

SEQ ID NO: 8568 - DNA, 1031 bp, Artificial Sequence; identical to SEQ ID NO: 7415
  Synthetic polypeptide

SEQ ID NO: 8569 - DNA, 1079 bp, Artificial Sequence; identical to SEQ ID NO: 7416
  Synthetic polypeptide

SEQ ID NO: 8570 - DNA, 1775 bp, Artificial Sequence; identical to SEQ ID NO: 568
  Synthetic polypeptide

SEQ ID NO: 8571 - DNA, 1418 bp, Artificial Sequence
  Synthetic polypeptide
ctccttccacggtctccctctgatgccgagccaaagctggacggtactgctgccatctcggctcactgcaacctccctgcctgattctcctgcctcagcctgccgagggcctgcgattgcaggcgcgcgccaccacgcctgactggttttcgtacttttttggtggagacggggtttcactgtgttggccgggctggtctccagctcctaaccgcgagtgatccgccagccttggcctcccaaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcctggccgccaccccgtctgggaagtgaggagcgtctctgcctggccgcccatcgtctgggatacgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatga

SEQ ID NO: 8572 - DNA, 1446 bp, Artificial Sequence
  Synthetic polypeptide
ggcccggcgcggtggctcacgcctgtaatcccagcactttgggaggctgaggctggtggatcacgagatcaggaaatcgagaccatcctggctaacacgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaa

SEQ ID NO: 8573 - DNA, 104 bp, Artificial Sequence
  Synthetic polypeptide
ggcccggcgcggtggctcacgcctgtaatcccagcactttgggaggctgaggctggtggatcacgagatcaggaaatcgagaccatcctggctaacacgcgtga

SEQ ID NO: 8574 - DNA, 489 bp, Artificial Sequence
  Synthetic polypeptide
ggcccggcgcggtggctcacgcctgtaatcccagcactttgggaggctgaggctggtggatcacgagatcaggaaatcgagaccatcctggctaacacgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggtaagtatagtactttaa

SEQ ID NO: 8575 - DNA, 306 bp, Artificial Sequence
  Synthetic polypeptide
gagggagatggggtaggtggagttgagggagatggggtagaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactga

SEQ ID NO: 8576 - DNA, 761 bp, Artificial Sequence; identical to SEQ ID NO: 7260
  Synthetic polypeptide

SEQ ID NO: 8577 - DNA, 675 bp, Artificial Sequence; identical to SEQ ID NO: 7261
  Synthetic polypeptide

SEQ ID NO: 8578 - DNA, 779 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 8579 - DNA, 409 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 8580 - DNA, 6463 bp, Artificial Sequence
  Synthetic polypeptide
tctaaaattttaggtaataggaatgtcagagtattaacaattatgagaatcataagaaaacaagacactatcaaacataaggagagatggggggaacagaacttacagaaatttaaaaatcatcaaagtggataacttattcagcaaattagaaataggtggattggaaggtgaatttgaataaatcactcaggatgcgcagagaaaaagagatggaaatatgaaagaggtcaagagacaagaagaataaaatgagaaggtttaacatatgtttgaaaagagttcctgaagaagataaagaaattgaggagggatgacagtcaaagaaagaatggctaaaattttttccagaatggatgaaagacgtaagtcctcagattcagaagcccagtattcctgagcactacaaaataaaaataaaactacatctagacacaatattgtaaagctacagaacattgaaaaacagaatgttaaaagcaacccaaaagaaaagacgtattatttacaaaggaaagactatcagcttttcttgatttctcaacagcagcattggaggccaggaagcattggaataattttttcaaagtgctgaggatataattgacagcctagaattttaaacatagctatactatcaagagtagtatgaaataaagagcttttcaaagagactaagagaatttaccattaacagacccttgctaattgaactgctcaaggatgtacttcaggaagaagaaaattgaacctaagatggaagaaataagatctaagaaggaatggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaa

SEQ ID NO: 8581 - DNA, 12665 bp, Artificial Sequence
  Synthetic polypeptide
gaagagccaagaaaatattgaaaatgtaatgaagtacttattagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaa

SEQ ID NO: 8582 - DNA, 4559 bp, Artificial Sequence
  Synthetic polypeptide
gaagagccaagaaaatattgaaaatgtaatgaagtacttattagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcagggtacctcggctgaataa

SEQ ID NO: 8583 - DNA, 952 bp, Artificial Sequence
  Synthetic polypeptide
ttttacttaaaattttctttgttgttttttctcctacccattagaatgtaagttccataaagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtga

SEQ ID NO: 8584 - DNA, 87 bp, Artificial Sequence
  Synthetic polypeptide
ttttacttaaaattttctttgttgttttttctcctacccattagaatgtaagttccataaagtccggttctccaccgagggacatga

SEQ ID NO: 8585 - DNA, 3220 bp, Artificial Sequence
  Synthetic polypeptide
cactcccagttttgaaagttctattatgagtaaaatgctatcagacagcatcgcatgctacagagaaatctttgtgaaaggaagagtcaatggatgtggcaaacttcattgttgtcttagtttaagaaattgccatagccatcacaaccttcagtagccacttctctcatcagtcagcagccgtcatcgaggcaagactctccaccagcacaaagattacaactcaactgaaggctcagatgattattagcattttatagcaatgatgtattttaaaattaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaa

SEQ ID NO: 8586 - DNA, 809 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8587 - DNA, 809 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8588 - DNA, 2208 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8589 - DNA, 2358 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8590 - DNA, 2223 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8591 - DNA, 2286 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8592 - DNA, 2004 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8593 - DNA, 2001 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacaattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8594 - DNA, 3545 bp, Artificial Sequence
  Synthetic polypeptide
ttcacccggtagtttaatgtggctttgtagaagaatcagtatttccctccttagagtccctctgtgacttactttctaacatagctccactgtatctcacaggaccccggatgccccagcccccatccttcccaaattcatccgcttcttccccttctcttcgggtttactctgctttagccgtgcggatcttctttccattatggaatatgtccggactactcccacccgtcagattttgtacttgtggttcccactagaagcatccagaatgtttttcctctctaccctcccccattctttcattggatgaccttattctcattcttctggtaataatcagggttaacacctctctgaccacctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggagccctggctctgggttctcactggggctccccaagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctga

SEQ ID NO: 8595 - DNA, 3542 bp, Artificial Sequence
  Synthetic polypeptide
ttcacccggtagtttaatgtggctttgtagaagaatcagtatttccctccttagagtccctctgtgacttactttctaacatagctccactgtatctcacaggaccccggatgccccagcccccatccttcccaaattcatccgcttcttccccttctcttcgggtttactctgctttagccgtgcggatcttctttccattatggaatatgtccggactactcccacccgtcagattttgtacttgtggttcccactagaagcatccagaatgtttttcctctctaccctcccccattctttcattggatgaccttattctcattcttctggtaataatcagggttaacacctctctgaccacctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctga

SEQ ID NO: 8596 - DNA, 1628 bp, Artificial Sequence
  Synthetic polypeptide
ttcacccggtagtttaatgtggctttgtagaagaatcagtatttccctccttagagtccctctgtgacttactttctaacatagctccactgtatctcacaggaccccggatgccccagcccccatccttcccaaattcatccgcttcttccccttctcttcgggtttactctgctttagccgtgcggatcttctttccattatggaatatgtccggactactcccacccgtcagattttgtacttgtggttcccactagaagcatccagaatgtttttcctctctaccctcccccattctttcattggatgaccttattctcattcttctggtaataatcagggttaacacctctctgaccacctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtccaccaggtattcccggaccaccaggcccccctggagtacctgggctgcaggtaaagggggagaagagaatgaggagcttgggtggcagagctcatgggtcaggatggctgctcccggctggaccccaaggatgctgctcccccaccccaaaaacacagacatgccatttctcactcctctgtttacctgcctcccagggtggcaaggagggcccactgagcctctag

SEQ ID NO: 8597 - DNA, 782 bp, Artificial Sequence
  Synthetic polypeptide
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaa

SEQ ID NO: 8598 - DNA, 668 bp, Artificial Sequence
  Synthetic polypeptide
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagaagcgtcagcccccgtag

SEQ ID NO: 8599 - DNA, 653 bp, Artificial Sequence
  Synthetic polypeptide
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtag

SEQ ID NO: 8600 - DNA, 221 bp, Artificial Sequence
  Synthetic polypeptide
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtcggccaggtcaacgtggagatggatgccaccccaggcattgacctgacccgc

SEQ ID NO: 8601 - DNA, 170 bp, Artificial Sequence
  Synthetic polypeptide
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtc

SEQ ID NO: 8602 - DNA, 1257 bp, Artificial Sequence
  Synthetic polypeptide
ccccctcccccctcccccctcccccctctcccctctcccctctcccctctccccggtctccctctgatgccaagccgaagctggactgtactgctgccatctcggctcactgcaacctccctgcctgattctcctgcctaagcctgccgagtgcctgcaattgcaggtgcgcgctgccacgcctgactggttttcgtattttttgggtggagacggggtttcgctgtgttggcagggctggtctccagctcctaaccgcgagtgatccgccagcctcggcctcccgaggtgccgggattgcagacggagtctccttcactcagtgctcaatggtgccgaggctggagtgcagtggcgtgatctcagctcgctacaacatccacctcccagcagcctgccttggcctcctaaagagccgagattgcagcctctgcccggccgccaccccgtctgggaagtgaggagcgtctctgcctggccgcccatcgtctgggatgtgaggagcccctctgcctggctgctcagtctggaaagtgaggagtgtctctgcccagccgccatcccatctaggaagtgaggagcgcctcttcccagccgccatcccatctaggaagtgaggagcgtctctgcccggccgccccgtctgagaagtgaggagaccctctgcctggcaaccgccctgtctgagaagtgaggagcccctccgcccagcagccgccccgtctgagaagtgaggagcctccgcccggcagccaccccgtctgggaagtacccattcctggcccagtgggtaacaagagaatggttcatttttccccggattctcatcaccatgaccattggtttagccctggggctaggacagagcatgaccagcatcagcttctgagagataatcgagctgaaagaggacacaagaaaaattgttctgtgagaacagccagcaggcaaacaagcatgcatttaggatccttatgcacgggagatatcaaacggagaagaaaagctgcacctttgcctggacctactactgcaggatttgtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaa

SEQ ID NO: 8603 - DNA, 2502 bp, Artificial Sequence
  Synthetic polypeptide
ggccgggcgtggtagtttacgcctataatcccagcactttgggaggctgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtga

SEQ ID NO: 8604 - DNA, 441 bp, Artificial Sequence
  Synthetic polypeptide
ggccgggcgtggtagtttacgcctataatcccagcactttgggaggctgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagggaggcctcagccgggtccagctcccagcctcagcggctgattcacacctgccttgctcccgtgtcagagtccatatcagcagacagctggaggtggagcccgaggagccggaggcggagaacaagcacaagccccgcaggaagtcaaagcggggcaagaaggaggcggaggacgagctga

SEQ ID NO: 8605 - DNA, 2454 bp, Artificial Sequence
  Synthetic polypeptide
ggccgggcgtggtagtttacgcctataatcccagcactttgggaggctgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtga

SEQ ID NO: 8606 - DNA, 961 bp, Artificial Sequence; identical to SEQ ID NO: 6722
  Synthetic polypeptide

SEQ ID NO: 8607 - DNA, 1508 bp, Artificial Sequence
  Synthetic polypeptide
gtgggaccttgggcaagtcagttttaagtgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagctgtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8608 - DNA, 1456 bp, Artificial Sequence
  Synthetic polypeptide
gtgggaccttgggcaagtcagttttaagtgtgaccttggagatacctcatcatatcacacaaaggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagctgtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8609 - DNA, 1448 bp, Artificial Sequence
  Synthetic polypeptide
gtgggaccttgggcaagtcagttttaagtgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagctgtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8610 - DNA, 3692 bp, Artificial Sequence
  Synthetic polypeptide
gggatgatggagggagctcctgcacggcacagaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 8611 - DNA, 3536 bp, Artificial Sequence
  Synthetic polypeptide
gggatgatggagggagctcctgcacggcacagaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 8612 - DNA, 3647 bp, Artificial Sequence
  Synthetic polypeptide
gggatgatggagggagctcctgcacggcacagaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 8613 - DNA, 809 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8614 - DNA, 971 bp, Artificial Sequence
  Synthetic polypeptide
ttgcctgtcagctccaaattcacccttttatcccgctgtgtgagaaggttctgtgttcctctgcctctgcccgctgtgcagttgatagtgaaggccacctgtagagagcaccagagtcagctaaggggagagctgcgcttcctggttctcccgctggcgccagcggtcctgctgagcgcaaaacttctcttccggactctggcgccccacacaggttcccagtgttaggctgggggagggcacgcgaaagcggtcagcttcccttccttccatccgccttgagcctttccggattggtgcttctggtgagacgcctccccatgagcatcactcccaagcacgcgagggggcacgtttcccataactcccaaacggcaagtttctacaaagttacaacagtggggaggcgccacaacttcactgccattttgtgaggtgctgccgcccctcctccggcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8615 - DNA, 971 bp, Artificial Sequence
  Synthetic polypeptide
ttgcctgtcagctccaaattcacccttttatcccgctgtgtgagaaggttctgtgttcctctgcctctgcccgctgtgcagttgatagtgaaggccacctgtagagagcaccagagtcagctaaggggagagctgcgcttcctggttctcccgctggcgccagcggtcctgctgagcgcaaaacttctcttccggactctggcgccccacacaggttcccagtgttaggctgggggagggcacgcgaaagcggtcagcttcccttccttccatccgccttgagcctttccggattggtgcttctggtgagacgcctccccatgagcatcactcccaagcacgcgagggggcacgtttcccataactcccaaacggcaagtttctacaaagttacaacagtggggaggcgccacaacttcactgccattttgtgaggtgctgccgcccctcctccggcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8616 - DNA, 628 bp, Artificial Sequence
  Synthetic polypeptide
gggcgcggtgactcatgcctgtaatcccagcactttgggaggccaaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttgtccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgcccgactgtgacgaatgatcgctcggcacccatcattcgatga

SEQ ID NO: 8617 - DNA, 971 bp, Artificial Sequence
  Synthetic polypeptide
ttgcctgtcagctccaaattcacccttttatcccgctgtgtgagaaggttctgtgttcctctgcctctgcccgctgtgcagttgatagtgaaggccacctgtagagagcaccagagtcagctaaggggagagctgcgcttcctggttctcccgctggcgccagcggtcctgctgagcgcaaaacttctcttccggactctggcgccccacacaggttcccagtgttaggctgggggagggcacgcgaaagcggtcagcttcccttccttccatccgccttgagcctttccggattggtgcttctggtgagacgcctccccatgagcatcactcccaagcacgcgagggggcacgtttcccataactcccaaacggcaagtttctacaaagttacaacagtggggaggcgccacaacttcactgccattttgtgaggtgctgccgcccctcctccggcaagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8618 - DNA, 1418 bp, Artificial Sequence
  Synthetic polypeptide
ggccgggcactgtggctgacgcctgtaatcctagcactttgagaggccgaggcggcggatcacgaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtga

SEQ ID NO: 8619 - DNA, 1595 bp, Artificial Sequence
  Synthetic polypeptide
ggccgggcactgtggctgacgcctgtaatcctagcactttgagaggccgaggcggcggatcacgaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccaaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtga

SEQ ID NO: 8620 - DNA, 771 bp, Artificial Sequence
  Synthetic polypeptide
ctagatcctaagctctttgcaggggaatcttcctttgtttggttcgcagataaatcccaagcccgtagaacttcatcttgcacatggaaccagctgtctcctgaagaggaggagaagcgtcgcatccggcgggagaggaacaagctggctgcagccaagtgccggaaccgacgccgggagctgacagagaagctgcaggcgattggtccctggcaggttgctgtccctcacatccctctctttccgtggcaggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaa

SEQ ID NO: 8621 - DNA, 720 bp, Artificial Sequence
  Synthetic polypeptide
ctagatcctaagctctttgcaggggaatcttcctttgtttggttcgcagataaatcccaagcccgtagaacttcatcttgcacatggaaccagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaa

SEQ ID NO: 8622 - DNA, 464 bp, Artificial Sequence
  Synthetic polypeptide
ctagatcctaagctctttgcaggggaatcttcctttgtttggttcgcagataaatcccaagcccgtagaacttcatcttgcacatggaaccagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggccca

SEQ ID NO: 8623 - DNA, 1056 bp, Artificial Sequence
  Synthetic polypeptide
ctggagtctcttaaaaagttaaaaatgtaccatatgccattctactcccaaatatttatccaagagaaatgaaaacatatgtctacacaaagatttacactccagtgttcatgagtgctatattcataatggcacaaaaaaaataaaacccagactggaatcaattaaaatacccatcagcagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaa

SEQ ID NO: 8624 - DNA, 1227 bp, Artificial Sequence
  Synthetic polypeptide
ctggagtctcttaaaaagttaaaaatgtaccatatgccattctactcccaaatatttatccaagagaaatgaaaacatatgtctacacaaagatttacactccagtgttcatgagtgctatattcataatggcacaaaaaaaataaaacccagactggaatcaattaaaatacccatcagcagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaa

SEQ ID NO: 8625 - DNA, 1056 bp, Artificial Sequence
  Synthetic polypeptide
ctggagtctcttaaaaagttaaaaatgtaccatatgccattctactcccaaatatttatccaagagaaatgaaaacatatgtctacacaaagatttacactccagtgttcatgagtgctatattcataatggcacaaaaaaaataaaacccagactggaatcaattaaaatacccatcagcagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagggctttttgttactgtttga

SEQ ID NO: 8626 - DNA, 891 bp, Artificial Sequence
  Synthetic polypeptide
ggccagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattga

SEQ ID NO: 8627 - DNA, 903 bp, Artificial Sequence
  Synthetic polypeptide
tggctgaggtcacagttgggactgagaggagatttgagctccagacttgattccacctcgtcagacttctatggccttgggctagctccttcgccccatcccaaactgagcctcactttccccatctgcataatggaaatgaggataatgatgattttcagctttcggggtagacaggaagatcacacaggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctcccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtga

SEQ ID NO: 8628 - DNA, 1896 bp, Artificial Sequence
  Synthetic polypeptide
ctgggagaaacagcaagcagaagtacccgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagcctctctccttgcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactga

SEQ ID NO: 8629 - DNA, 1803 bp, Artificial Sequence
  Synthetic polypeptide
ctgggagaaacagcaagcagaagtacccgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactga

SEQ ID NO: 8630 - DNA, 1014 bp, Artificial Sequence
  Synthetic polypeptide
ctgggagaaacagcaagcagaagtacccgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggtctgtgggctgaaatacgtggtttattgtgaggacgacgtttgtcacttacctgtcctgagtctgggcgccaaggaggcatgggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaaggtagggtcatcgtccgtggttccggaccaggcctgcatcagccagcgcttcctgcagggaaccatcattgccctggtggtggtcatggccttcaggcatcacctgggagcccagcctcaggagcaaggaccacagccttgtcctagagagagggcactggatggtggctccagctctaacggtcacccttttctgtggctccagcgtggtgtccatgtccacactgtacgtgctgagcctgcgcacagaggaggacctggtagacactga

SEQ ID NO: 8631 - DNA, 2271 bp, Artificial Sequence
  Synthetic polypeptide
caaactcagtatcaccagtaatggaacaaaatgacattgtgtctttgcattgtatcatatcaagaggaggcatgataacattaccaatgtaaatttcttgtcaaatgtttatctagaatctgatcatgatacaacaaagagatccagtgtgggacattctacaaaaagctggtctgatctttaaaaaaggtcaatgccataaaagactataaaaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaa

SEQ ID NO: 8632 - DNA, 3591 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaa

SEQ ID NO: 8633 - DNA, 3504 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaatttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaa

SEQ ID NO: 8634 - DNA, 3531 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatga

SEQ ID NO: 8635 - DNA, 1132 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcagg

SEQ ID NO: 8636 - DNA, 1078 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatg

SEQ ID NO: 8637 - DNA, 3438 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttga

SEQ ID NO: 8638 - DNA, 3621 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaa

SEQ ID NO: 8639 - DNA, 1043 bp, Artificial Sequence
  Synthetic polypeptide
tgatatggttcagctgtgtccctgggcaaatatcaacttgaattgtatctcccagaattcgcacatgttgtgggagggaccaaagaggaactggttgaatcatgaggccggtctttcccgtgctattctcatgatagtgaataagtctcacgagatctggtgggttcatcaggggtttccgcttttgcttcctcctcattttctcttgccactgccatgtaagaagtgccttttgcctcctgccatgattcagaggcctctcagctatgtggtactgccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctag

SEQ ID NO: 8640 - DNA, 366 bp, Artificial Sequence
  Synthetic polypeptide
tgatatggttcagctgtgtccctgggcaaatatcaacttgaattgtatctcccagaattcgcacatgttgtgggagggaccaaagaggaactggttgaatcatgaggccggtctttcccgtgctattctcatgatagtgaataagtctcacgagatctggtgggttcatcaggggtttccgcttttgcttcctcctcattttctcttgccactgccatgtaagaagtgccttttgcctcctgccatgattcagaggcctctcagctatgtggtactgccctgaagaggaaagtgaggatgactctcatctcgaaggcagggatcctgatatttggcatgttggttttaagatctcatgggacatag

SEQ ID NO: 8641 - DNA, 384 bp, Artificial Sequence
  Synthetic polypeptide
ggctgggtgcagtggctcatgcctgtcatcccagcactttgggaggctgaagtgggcagatctctggaggtcaggagttcaagacctgcctggccaatatggtgaaaccccatctctactaaaaatacaaaaattacctaggcatggtggtgagcatctgtaatcccagctactcagaggctgaggtaggagaatcgcttgaacctgggaggcagaggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataa

SEQ ID NO: 8642 - DNA, 345 bp, Artificial Sequence
  Synthetic polypeptide
ggctgggtgcagtggctcatgcctgtcatcccagcactttgggaggctgaagtgggcagatctctggaggtcaggagttcaagacctgcctggccaatatggtgaaaccccatctctactaaaaatacaaaaattacctaggcatggtggtgagcatctgtaatcccagctactcagaggctgaggtaggagaatcgcttgaacctgggaggcagaggtcttggctgttcaaccgtactttctccagaaggatcagctcaatttgctgctcagatatttgggttaagcaaccatttggtatggagcaaactgcgagcaagcattttgaacacatggatttccttg

SEQ ID NO: 8643 - DNA, 809 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 8644 - DNA, 2140 bp, Artificial Sequence
  Synthetic polypeptide
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 8645 - DNA, 1561 bp, Artificial Sequence
  Synthetic polypeptide
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatag

SEQ ID NO: 8646 - DNA, 1630 bp, Artificial Sequence
  Synthetic polypeptide
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctga

SEQ ID NO: 8647 - DNA, 1765 bp, Artificial Sequence
  Synthetic polypeptide
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctga

SEQ ID NO: 8648 - DNA, 2128 bp, Artificial Sequence
  Synthetic polypeptide
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 8649 - DNA, 713 bp, Artificial Sequence
  Synthetic polypeptide
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattg

SEQ ID NO: 8650 - DNA, 1763 bp, Artificial Sequence
  Synthetic polypeptide
agattgataccaagaagtgggagtgcttctaacgaatgtggaagtggctttggaaatgggtaatgggtagaaactggaaagagttcggaggtgcacactagaaaaagcctacattgctgtgaattgacctttaaaggtgattctggtgaaggctcagaaagaaaagaggagagctataaagaaagccttaatcctcctagaaaatacctaagtgatcatgaacagaacgttggcagaaatatgggtaataaaggccagtctgataaggtctcagagggaaatgaggaccatgttattggacaatggagaaaaagccatcggggtgggggggaaagggaagggagagcatcaggacaaatacctaatgcatgcagggcttaaaacttagatgacaggttgatagatgcagtaaaccacatgtatacctgtgtaacaaacctgcacgttcagcacatatatcccagaacttaaagtaaaagaaaacaaatttttttaaaaagcgtcagagaacttggctgaattgtgcctgtattctagtgttttgcagaaggtagagcggtgaacactgaaattacatatttggataaggaaatttctaggcaaagtgtgaaagttgtggcttggcttctcttgacagcctacattaaaatgtgaaaagagagaaaagatttaaagacagaattgttaatcaaagagaagcagcacttaaagatttggaaaattctcaccctagccatattatgaagaatgagataacgggtacagtggttcatgcctgtagtcctaactgttagagaagtggaggcaggaggatcccttaaacccaggagtttgagacttgtctgagtaacatagtgagagtccatctcttaaaaaagaataaataaataaatgagaaggcacattgggaaagaacaccaagggtgcggccaaatgaccatctgataaggagattagtcaaccaagtggaacctgttgctcaaggtgattcagaagtaattggggctgccacctccatcacagctccaatgtgcaaaagcttgagcaggcaagcatgggacctccacagagagcccttactagagcaacatccaggatagccgagtggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattga

SEQ ID NO: 8651 - DNA, 1724 bp, Artificial Sequence
  Synthetic polypeptide
agattgataccaagaagtgggagtgcttctaacgaatgtggaagtggctttggaaatgggtaatgggtagaaactggaaagagttcggaggtgcacactagaaaaagcctacattgctgtgaattgacctttaaaggtgattctggtgaaggctcagaaagaaaagaggagagctataaagaaagccttaatcctcctagaaaatacctaagtgatcatgaacagaacgttggcagaaatatgggtaataaaggccagtctgataaggtctcagagggaaatgaggaccatgttattggacaatggagaaaaagccatcggggtgggggggaaagggaagggagagcatcaggacaaatacctaatgcatgcagggcttaaaacttagatgacaggttgatagatgcagtaaaccacatgtatacctgtgtaacaaacctgcacgttcagcacatatatcccagaacttaaagtaaaagaaaacaaatttttttaaaaagcgtcagagaacttggctgaattgtgcctgtattctagtgttttgcagaaggtagagcggtgaacactgaaattacatatttggataaggaaatttctaggcaaagtgtgaaagttgtggcttggcttctcttgacagcctacattaaaatgtgaaaagagagaaaagatttaaagacagaattgttaatcaaagagaagcagcacttaaagatttggaaaattctcaccctagccatattatgaagaatgagataacgggtacagtggttcatgcctgtagtcctaactgttagagaagtggaggcaggaggatcccttaaacccaggagtttgagacttgtctgagtaacatagtgagagtccatctcttaaaaaagaataaataaataaatgagaaggcacattgggaaagaacaccaagggtgcggccaaatgaccatctgataaggagattagtcaaccaagtggaacctgttgctcaaggtgattcagaagtaattggggctgccacctccatcacagctccaatgtgcaaaagcttgagcaggcaagcatgggacctccacagagagcccttactagagcaacatccaggatagccgagtggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacc

SEQ ID NO: 8652 - DNA, 796 bp, Artificial Sequence
  Synthetic polypeptide
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaa

SEQ ID NO: 8653 - DNA, 383 bp, Artificial Sequence
  Synthetic polypeptide
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagatttta

SEQ ID NO: 8654 - DNA, 155 bp, Artificial Sequence
  Synthetic polypeptide
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgtt

SEQ ID NO: 8655 - DNA, 118 bp, Artificial Sequence
  Synthetic polypeptide
ggctgggtgcgatggctcatgcctgtaatcccagcactttgggaggctgagttttaagacaattatctcctatattgatgagcaatttgagaggtacctgcatgacgagagcggcttg

SEQ ID NO: 8656 - DNA, 193 bp, Artificial Sequence
  Synthetic polypeptide
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaag

SEQ ID NO: 8657 - DNA, 103 bp, Artificial Sequence
  Synthetic polypeptide
ggctgggtgcgatggctcatgcctgtaatcccagcactttgggaggctgagttttaagacaattatctcctatattgatgagcaatttgagaggtacctgcat

SEQ ID NO: 8658 - DNA, 230 bp, Artificial Sequence
  Synthetic polypeptide
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaaca

SEQ ID NO: 8659 - DNA, 279 bp, Artificial Sequence
  Synthetic polypeptide
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaa

SEQ ID NO: 8660 - DNA, 2609 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8661 - DNA, 2360 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8662 - DNA, 2753 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8663 - DNA, 2291 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8664 - DNA, 2255 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8665 - DNA, 2510 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8666 - DNA, 2348 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8667 - DNA, 2417 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8668 - DNA, 2690 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8669 - DNA, 2741 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8670 - DNA, 799 bp, Artificial Sequence
  Synthetic polypeptide
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagca

SEQ ID NO: 8671 - DNA, 926 bp, Artificial Sequence
  Synthetic polypeptide
ggccgggtgtggtggctgatcacgccactcccagcactttgggaggccaacgcgggcagatcatgaggtcaacagatcgagaccatcctggccaacatggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 8672 - DNA, 890 bp, Artificial Sequence
  Synthetic polypeptide
ggccgggtgtggtggctgatcacgccactcccagcactttgggaggccaacgcgggcagatcatgaggtcaacagatcgagaccatcctggccaacatggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 8673 - DNA, 878 bp, Artificial Sequence
  Synthetic polypeptide
ggccgggtgtggtggctgatcacgccactcccagcactttgggaggccaacgcgggcagatcatgaggtcaacagatcgagaccatcctggccaacatggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 8674 - DNA, 1352 bp, Artificial Sequence
  Synthetic polypeptide
tatacccaaaagaagatagttgtacacctatatccacagcagcattattcatagtagccaaaaggtagaagtaacccaagtatcttatcagtgaatgaatagtaaacaaaatacggtatatgcatccagtggaagattattcagccttaaagaagaaaattctgactacatgctgctatatgattccacttacatgagatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaa

SEQ ID NO: 8675 - DNA, 829 bp, Artificial Sequence
  Synthetic polypeptide
tatagattcctgggcttggtccccatcttacagaatcagcttctctggagttgaggcccaggaatggtcatttctaacaccctctccaggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtga

SEQ ID NO: 8676 - DNA, 796 bp, Artificial Sequence
  Synthetic polypeptide
ggccgggcgcggtggctcacacctgtaatcccagcactttgggaggccaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactga

SEQ ID NO: 8677 - DNA, 272 bp, Artificial Sequence
  Synthetic polypeptide
ggccgggcgcggtggctcacacctgtaatcccagcactttgggaggccaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaacc

SEQ ID NO: 8678 - DNA, 226 bp, Artificial Sequence
  Synthetic polypeptide
ggccgggcgcggtggctcacacctgtaatcccagcactttgggaggccaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaa

SEQ ID NO: 8679 - DNA, 175 bp, Artificial Sequence
  Synthetic polypeptide
ggccgggcgcggtggctcacacctgtaatcccagcactttgggaggccaaggcctgaagctgcccagcaggcattccaaggcctgggtcctggtttctccggttacacaccctatgggtggcttcagctttcctggttccagcagatatatgcacgacagtactacatgcaatag

SEQ ID NO: 8680 - DNA, 1083 bp, Artificial Sequence; identical to SEQ ID NO: 7080
  Synthetic polypeptide

SEQ ID NO: 8681 - DNA, 676 bp, Artificial Sequence
  Synthetic polypeptide
tgtgatggttaatactgagtgtcaacttgatggcattgaatgatgcaaagtattgaccctgagtgtgtctgttaaggtgttgacaaaggagattaacatttgagtcactgggctggaaaaggcagacccacccttaatctgtgtgggcacaatctaatcagcttcagacacagccaggatataaagcaggaagaaaaacgtgaaaaggtttgactggcttagcctcccagcctacatctttctctcgtgctttatgcttcctgccctcaaacactggactccaagttcttcagctttggaactcgaactggcttccttttgctcctcagattatgctttgatgcggcctggaagaattgatagaatcatctatgtgcctttaccggatgcagcaacaagaagggaaatatttaagctgcagtttcactccatgcctgtcagtaatgaagttgacctggatgaactcatccttcaaaccgacgcatactcaggagcagagattgtagctgtctgcagagaggcagctcttctggctctggaagaagacattcaagccaatctcatcatgaaaagacatttcactcaggccttgagcactgtgacacctagaattcctgagtcattgagacgtttttatgaagattatcaagagaagagtgggctgcatacactctga

SEQ ID NO: 8682 - DNA, 3910 bp, Artificial Sequence
  Synthetic polypeptide
gctgggtgtggtggctcacgcctataatcccagcactttgggaagccaaggctcttttaagacacttactcttccatcagaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagagcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtga

SEQ ID NO: 8683 - DNA, 4090 bp, Artificial Sequence
  Synthetic polypeptide
gctgggtgtggtggctcacgcctataatcccagcactttgggaagccaaggctcttttaagacacttactcttccatcactacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtga

SEQ ID NO: 8684 - DNA, 4141 bp, Artificial Sequence
  Synthetic polypeptide
gctgggtgtggtggctcacgcctataatcccagcactttgggaagccaaggctcttttaagacacttactcttccatcactacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagagcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtga

SEQ ID NO: 8685 - DNA, 1995 bp, Artificial Sequence
  Synthetic polypeptide
ctctccctcctctccccctccccctccccctctccccacggtctccctctccctctctttccacggtctccctctgatgcccagccgaggctggactgtactgctgccatctcggctcactgcaacctccctgcctgattctcctgcctcagcctgccaagtgcctgcgattgcaggcacgcgccgccacgcctgactggttttcgtatttttttggtggagacggggtttcgctgtgttggctgggctggtctccaactcctaaccgcgagtgatccgccagcctcggcatcccgaggtgccgggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcccggccgccaccctgtctgggaagtgaggagcgcctcttcccggccgcccattgtctgggatgtgaggagcccctctgcctggctgcccagtctggaaagtgaggagcgtctctgccgggccgccatcccatctaggaagtgaggagcgcctcttcccggccgccatcccatctaggaagtgaggagcgtctctgcccgctgcccatcgtctgagatgtggggagcgcctctgccctgctgccccgtctgggatgtgaggagcgtctctgcccggctgccccgtctgagaagtgaggagaccctctgcctggcaactgccccgtctgagaagtgcggagcccctccgcccggcagccaccccgtctgagaaaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtag

SEQ ID NO: 8686 - DNA, 1620 bp, Artificial Sequence
  Synthetic polypeptide
ctctccctcctctccccctccccctccccctctccccacggtctccctctccctctctttccacggtctccctctgatgcccagccgaggctggactgtactgctgccatctcggctcactgcaacctccctgcctgattctcctgcctcagcctgccaagtgcctgcgattgcaggcacgcgccgccacgcctgactggttttcgtatttttttggtggagacggggtttcgctgtgttggctgggctggtctccaactcctaaccgcgagtgatccgccagcctcggcatcccgaggtgccgggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcccggccgccaccctgtctgggaagtgaggagcgcctcttcccggccgcccattgtctgggatgtgaggagcccctctgcctggctgcccagtctggaaagtgaggagcgtctctgccgggccgccatcccatctaggaagtgaggagcgcctcttcccggccgccatcccatctaggaagtgaggagcgtctctgcccgctgcccatcgtctgagatgtggggagcgcctctgccctgctgccccgtctgggatgtgaggagcgtctctgcccggctgccccgtctgagaagtgaggagaccctctgcctggcaactgccccgtctgagaagtgcggagcccctccgcccggcagccaccccgtctgagaaaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtag

SEQ ID NO: 8687 - DNA, 1691 bp, Artificial Sequence; identical to SEQ ID NO: 7480
  Synthetic polypeptide

SEQ ID NO: 8688 - DNA, 1727 bp, Artificial Sequence; identical to SEQ ID NO: 7481
  Synthetic polypeptide

SEQ ID NO: 8689 - DNA, 629 bp, Artificial Sequence; identical to SEQ ID NO: 7482
  Synthetic polypeptide

SEQ ID NO: 8690 - DNA, 1553 bp, Artificial Sequence; identical to SEQ ID NO: 7483
  Synthetic polypeptide

SEQ ID NO: 8691 - DNA, 959 bp, Artificial Sequence
  Synthetic polypeptide
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 8692 - DNA, 316 bp, Artificial Sequence
  Synthetic polypeptide
ggccgggcgcggtggctcacgcctgtaatcccagcactttgggaggccgaggcgggcagatcacgaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtag

SEQ ID NO: 8693 - DNA, 1382 bp, Artificial Sequence
  Synthetic polypeptide
ttctcccaaaagcttatccccagtctaataagaaaaacatcagacaaattccagtagaggggcatcctacaagatacctgaccagcattcccaaaattgtcacagcgaagaggagcttatggagacatgcaactaagcataatgtggtgtcctagatggaatcgtggaacagaaatagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaa

SEQ ID NO: 8694 - DNA, 1253 bp, Artificial Sequence
  Synthetic polypeptide
ttctcccaaaagcttatccccagtctaataagaaaaacatcagacaaattccagtagaggggcatcctacaagatacctgaccagcattcccaaaattgtcacagcgaagaggagcttatggagacatgcaactaagcataatgtggtgtcctagatggaatcgtggaacagaaatagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaagtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaa

SEQ ID NO: 8695 - DNA, 625 bp, Artificial Sequence; identical to SEQ ID NO: 6804
  Synthetic polypeptide

SEQ ID NO: 8696 - DNA, 598 bp, Artificial Sequence; identical to SEQ ID NO: 6805
  Synthetic polypeptide

SEQ ID NO: 8697 - DNA, 127 bp, Artificial Sequence
  Synthetic polypeptide
ggccaggtgcaatgggtcaagcctgcaatccccacaccaaggtgggagtattgcttgaaaccaggagttcaagaccagcctaggcaagaaagtattggcatactccacacatctgtaccattcttga

SEQ ID NO: 8698 - DNA, 689 bp, Artificial Sequence
  Synthetic polypeptide
cagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagccgccccgtctgagaagtgaggagcctctccacccggcagccaccccatctgggaatgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaag

SEQ ID NO: 8699 - DNA, 809 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8700 - DNA, 394 bp, Artificial Sequence
  Synthetic polypeptide
gtgactgcaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaa

SEQ ID NO: 8701 - DNA, 809 bp, Artificial Sequence; identical to SEQ ID NO: 8699
  Synthetic polypeptide

SEQ ID NO: 8702 - DNA, 740 bp, Artificial Sequence; identical to SEQ ID NO: 7794
  Synthetic polypeptide

SEQ ID NO: 8703 - DNA, 1759 bp, Artificial Sequence; identical to SEQ ID NO: 6644
  Synthetic polypeptide

SEQ ID NO: 8704 - DNA, 588 bp, Artificial Sequence
  Synthetic polypeptide
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtga

SEQ ID NO: 8705 - DNA, 585 bp, Artificial Sequence
  Synthetic polypeptide
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttag

SEQ ID NO: 8706 - DNA, 606 bp, Artificial Sequence
  Synthetic polypeptide
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctag

SEQ ID NO: 8707 - DNA, 384 bp, Artificial Sequence
  Synthetic polypeptide
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacc

SEQ ID NO: 8708 - DNA, 193 bp, Artificial Sequence
  Synthetic polypeptide
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggca

SEQ ID NO: 8709 - DNA, 170 bp, Artificial Sequence
  Synthetic polypeptide
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctg

SEQ ID NO: 8710 - DNA, 168 bp, Artificial Sequence
  Synthetic polypeptide
tggttctcaaagtgtggttcccagaacagcagcttcagcatcacctgagtttttaaaattgcatatccatccttggactcctccccagacctactgaatcagaaactctggagagacgttttctttggaccaaagatctctttcgtgattccttgcaacaatcaatga

SEQ ID NO: 8711 - DNA, 193 bp, Artificial Sequence; identical to SEQ ID NO: 7535
  Synthetic polypeptide

SEQ ID NO: 8712 - DNA, 1066 bp, Artificial Sequence; identical to SEQ ID NO: 7536
  Synthetic polypeptide

SEQ ID NO: 8713 - DNA, 1063 bp, Artificial Sequence; identical to SEQ ID NO: 7537
  Synthetic polypeptide

SEQ ID NO: 8714 - DNA, 404 bp, Artificial Sequence; identical to SEQ ID NO: 7538
  Synthetic polypeptide

SEQ ID NO: 8715 - DNA, 925 bp, Artificial Sequence; identical to SEQ ID NO: 7539
  Synthetic polypeptide

SEQ ID NO: 8716 - DNA, 1093 bp, Artificial Sequence; identical to SEQ ID NO: 7540
  Synthetic polypeptide

SEQ ID NO: 8717 - DNA, 261 bp, Artificial Sequence
  Synthetic polypeptide
ggctggacgtggtggctcacgcctgtaattccaacactctgggaggccgaggcaggtggatcacttgaggtcaggagttcgagaccagcctggccaacatggcgaaaccccgtgtcttctaaaaatacaaaatttagccaggtgtgatggcatgcgcctgtaatcccagctactcagaggctgagaccaaaaagaagaatgtacttcatctggttgggctggattccctctgataagccttcccagttgactgaaagatga

SEQ ID NO: 8718 - DNA, 233 bp, Artificial Sequence
  Synthetic polypeptide
ggctggacgtggtggctcacgcctgtaattccaacactctgggaggccgaggcaggtggatcacttgaggtcaggagttcgagaccagcctggccaacatggcgaaaccccgtgtcttctaaaaatacaaaatttagccaggtgtgatggcatgcgcctgtaatcccagctactcagaggctgagaccaaaaagaagaatgtacttcatctggttgggctggattccctctga

SEQ ID NO: 8719 - DNA, 560 bp, Artificial Sequence; identical to SEQ ID NO: 6322
  Synthetic polypeptide

SEQ ID NO: 8720 - DNA, 735 bp, Artificial Sequence
  Synthetic polypeptide
cctgggttctagacctggttctgccaattgcttgtcatgtgatgttgggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctga

SEQ ID NO: 8721 - DNA, 1133 bp, Artificial Sequence; identical to SEQ ID NO: 7332
  Synthetic polypeptide

SEQ ID NO: 8722 - DNA, 1172 bp, Artificial Sequence; identical to SEQ ID NO: 7333
  Synthetic polypeptide

SEQ ID NO: 8723 - DNA, 871 bp, Artificial Sequence; identical to SEQ ID NO: 437
  Synthetic polypeptide

SEQ ID NO: 8724 - DNA, 421 bp, Artificial Sequence; identical to SEQ ID NO: 441
  Synthetic polypeptide

SEQ ID NO: 8725 - DNA, 638 bp, Artificial Sequence; identical to SEQ ID NO: 442
  Synthetic polypeptide

SEQ ID NO: 8726 - DNA, 337 bp, Artificial Sequence; identical to SEQ ID NO: 443
  Synthetic polypeptide

SEQ ID NO: 8727 - DNA, 148 bp, Artificial Sequence; identical to SEQ ID NO: 6388
  Synthetic polypeptide

SEQ ID NO: 8728 - DNA, 1100 bp, Artificial Sequence; identical to SEQ ID NO: 6389
  Synthetic polypeptide

SEQ ID NO: 8729 - DNA, 464 bp, Artificial Sequence; identical to SEQ ID NO: 6390
  Synthetic polypeptide

SEQ ID NO: 8730 - DNA, 280 bp, Artificial Sequence; identical to SEQ ID NO: 6391
  Synthetic polypeptide

SEQ ID NO: 8731 - DNA, 369 bp, Artificial Sequence; identical to SEQ ID NO: 7297
  Synthetic polypeptide

SEQ ID NO: 8732 - DNA, 1029 bp, Artificial Sequence
  Synthetic polypeptide
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 8733 - DNA, 1170 bp, Artificial Sequence
  Synthetic polypeptide
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 8734 - DNA, 1062 bp, Artificial Sequence
  Synthetic polypeptide
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 8735 - DNA, 573 bp, Artificial Sequence
  Synthetic polypeptide
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggtgcttgtgactaa

SEQ ID NO: 8736 - DNA, 299 bp, Artificial Sequence
  Synthetic polypeptide
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgca

SEQ ID NO: 8737 - DNA, 1290 bp, Artificial Sequence; identical to SEQ ID NO: 6392
  Synthetic polypeptide

SEQ ID NO: 8738 - DNA, 1047 bp, Artificial Sequence
  Synthetic polypeptide
aacaccactggccaagaattggtaattgtggaagccagatggagatgattggtatatggaggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactga

SEQ ID NO: 8739 - DNA, 756 bp, Artificial Sequence
  Synthetic polypeptide
cagggccacctggtaaaggtatggaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatga

SEQ ID NO: 8740 - DNA, 742 bp, Artificial Sequence; identical to SEQ ID NO: 6357
  Synthetic polypeptide

SEQ ID NO: 8741 - DNA, 590 bp, Artificial Sequence; identical to SEQ ID NO: 6358
  Synthetic polypeptide

SEQ ID NO: 8742 - DNA, 577 bp, Artificial Sequence; identical to SEQ ID NO: 6359
  Synthetic polypeptide

SEQ ID NO: 8743 - DNA, 430 bp, Artificial Sequence; identical to SEQ ID NO: 6360
  Synthetic polypeptide

SEQ ID NO: 8744 - DNA, 670 bp, Artificial Sequence; identical to SEQ ID NO: 6361
  Synthetic polypeptide

SEQ ID NO: 8745 - DNA, 1293 bp, Artificial Sequence
  Synthetic polypeptide
gcgagaacacggttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtag

SEQ ID NO: 8746 - DNA, 147 bp, Artificial Sequence; identical to SEQ ID NO: 6327
  Synthetic polypeptide

SEQ ID NO: 8747 - DNA, 1833 bp, Artificial Sequence
  Synthetic polypeptide
ttttctatctcagtccaaggaaagggcctagaagccccagtaagaatgaatatttccagggactagattttgggttccaaatatggtttcccaccaaaaggaggcaatgttttttagagaagttcctgatttcttaatgtggggcaaagaagtcctggaacatattgtgttggaaagcaagaacgtgctcaaaaactgatggaaacatgtcaaaaaggcacaggagcctatttgaaagtttcctaccatcaaaacttgaaacaatttgaacatctaaaagaataatggtaggtatggattataacacattatgtgagagagaatttgtaagtccgtaattatactttaaaattaaaaaaaactcactttgttacaaagagaaaaaatggggaaatatacagttgttctttacagaagaaatgacacttaaaatgtagaaaaaatataaaattacaaaatcactaatttgcactaatgattgactccaggcaaggatcatcagtcattggatgttaaaaccattggaagaaaggctgtaggtgaacaggatatttacatggtctcaaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaaggttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaa

SEQ ID NO: 8748 - DNA, 1755 bp, Artificial Sequence
  Synthetic polypeptide
ttttctatctcagtccaaggaaagggcctagaagccccagtaagaatgaatatttccagggactagattttgggttccaaatatggtttcccaccaaaaggaggcaatgttttttagagaagttcctgatttcttaatgtggggcaaagaagtcctggaacatattgtgttggaaagcaagaacgtgctcaaaaactgatggaaacatgtcaaaaaggcacaggagcctatttgaaagtttcctaccatcaaaacttgaaacaatttgaacatctaaaagaataatggtaggtatggattataacacattatgtgagagagaatttgtaagtccgtaattatactttaaaattaaaaaaaactcactttgttacaaagagaaaaaatggggaaatatacagttgttctttacagaagaaatgacacttaaaatgtagaaaaaatataaaattacaaaatcactaatttgcactaatgattgactccaggcaaggatcatcagtcattggatgttaaaaccattggaagaaaggctgtaggtgaacaggatatttacatggtctcaaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaagggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaa

SEQ ID NO: 8749 - DNA, 792 bp, Artificial Sequence; identical to SEQ ID NO: 6418
  Synthetic polypeptide

SEQ ID NO: 8750 - DNA, 369 bp, Artificial Sequence; identical to SEQ ID NO: 6419
  Synthetic polypeptide

SEQ ID NO: 8751 - DNA, 249 bp, Artificial Sequence; identical to SEQ ID NO: 6420
  Synthetic polypeptide

SEQ ID NO: 8752 - DNA, 369 bp, Artificial Sequence; identical to SEQ ID NO: 6421
  Synthetic polypeptide

SEQ ID NO: 8753 - DNA, 843 bp, Artificial Sequence; identical to SEQ ID NO: 6422
  Synthetic polypeptide

SEQ ID NO: 8754 - DNA, 906 bp, Artificial Sequence
  Synthetic polypeptide
cagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaataattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttga

SEQ ID NO: 8755 - DNA, 795 bp, Artificial Sequence
  Synthetic polypeptide
cagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaataattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttga

SEQ ID NO: 8756 - DNA, 399 bp, Artificial Sequence
  Synthetic polypeptide
cagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaataattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaagcctgtgtaa

SEQ ID NO: 8757 - DNA, 393 bp, Artificial Sequence
  Synthetic polypeptide
cagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaataattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaagtga

SEQ ID NO: 8758 - DNA, 463 bp, Artificial Sequence
  Synthetic polypeptide
gtggtggaaagtccgtggaatctggggacagaagaccagagttcaagttgaagtcctgcttcctactcactgtgtgttttaaggaggtcctcagaactccctgagtatgagcagccccatctctcagacaccgtcatgggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaa

SEQ ID NO: 8759 - DNA, 220 bp, Artificial Sequence; identical to SEQ ID NO: 7991
  Synthetic polypeptide

SEQ ID NO: 8760 - DNA, 334 bp, Artificial Sequence; identical to SEQ ID NO: 7992
  Synthetic polypeptide

SEQ ID NO: 8761 - DNA, 163 bp, Artificial Sequence; identical to SEQ ID NO: 480
  Synthetic polypeptide

SEQ ID NO: 8762 - DNA, 104 bp, Artificial Sequence; identical to SEQ ID NO: 481
  Synthetic polypeptide

SEQ ID NO: 8763 - DNA, 348 bp, Artificial Sequence; identical to SEQ ID NO: 6363
  Synthetic polypeptide

SEQ ID NO: 8764 - DNA, 238 bp, Artificial Sequence; identical to SEQ ID NO: 6378
  Synthetic polypeptide

SEQ ID NO: 8765 - DNA, 158 bp, Artificial Sequence; identical to SEQ ID NO: 7602
  Synthetic polypeptide

SEQ ID NO: 8766 - DNA, 175 bp, Artificial Sequence
  Synthetic polypeptide
gtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaaga

SEQ ID NO: 8767 - DNA, 214 bp, Artificial Sequence
  Synthetic polypeptide
gtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtga

SEQ ID NO: 8768 - DNA, 157 bp, Artificial Sequence
  Synthetic polypeptide
ctcaccttggaccccttccctccttgcgctctgcttgatgtttaatcccatggaatcaatcaaattaaatcatcatgactacattgattccccatcgctgaaggacagaattcattgtgtggcatttgtatttgatgccagctctattcaatacttc

SEQ ID NO: 8769 - DNA, 535 bp, Artificial Sequence
  Synthetic polypeptide
ctcaccttggaccccttccctccttgcgctctgcttgatgtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatag

SEQ ID NO: 8770 - DNA, 1292 bp, Artificial Sequence
  Synthetic polypeptide
gccgggcacgatggctcacacctgtaaactcagcactttgggaggccaagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactga

SEQ ID NO: 8771 - DNA, 1082 bp, Artificial Sequence
  Synthetic polypeptide
gccgggcacgatggctcacacctgtaaactcagcactttgggaggccaagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgtttgatttgacagtttga

SEQ ID NO: 8772 - DNA, 354 bp, Artificial Sequence
  Synthetic polypeptide
gtctctccacttccactccagccccctacagctcatcctccagcaggcagccaagggcacttttaggatctcacatcaggtccttgcctcacattctgcactggcttcccaagtaattaaagtaaaatccaaattccagctcacagcttagaaaactcagcaggactggcctctgtcctatcccacaccccacctcagtccctcaagctcatctcctgtcattcctgcccatttctggaccccagccactcctcaaacagggtgaggatgcagtgtccaaggcaccatcttgaactcatcatcgccaaatatgtgagcaccttgatgttggacttcccaacctccagaccctga

SEQ ID NO: 8773 - DNA, 354 bp, Artificial Sequence
  Synthetic polypeptide
gtctctccacttccactccagccccctacagctcatcctccagcaggcagccaagggcacttttaggatctcacatcaggtccttgcctcacattctgcactggcttcccaagtaattaaagtaaaatccaaattccagctcacagcttagaaaactcagcaggactggcctctgtcctatcccacaccccacctcagtccctcaagctcatctcctgtcattcctgcccatttctggaccccagccactcctcaaacagggtgaggatgcagtgtccaaggcaccatcttgaactcatcatcgccaaatatgtgagcaccttgatgttggacttcccaacctccagaccgtaa

SEQ ID NO: 8774 - DNA, 336 bp, Artificial Sequence; identical to SEQ ID NO: 7520
  Synthetic polypeptide

SEQ ID NO: 8775 - DNA, 346 bp, Artificial Sequence; identical to SEQ ID NO: 7521
  Synthetic polypeptide

SEQ ID NO: 8776 - DNA, 1675 bp, Artificial Sequence
  Synthetic polypeptide
tactatagtttggatacttgtctccccaaacctcattgtgaaatgtgatccccagtgctggaggtggggcctaatggatggtggttgggtcatggggacagctccccatgagttcgttcttgctgtattagttccctccaaagctggttgttaaaaagaacctggtgcctccccctgtctctcttccttcctctcttaccatgtgatctggacacactggctccactttgccttctaccataagtggaatcagcctgaagcccccaccagaagcagatgcttgcgccatgcttcttgcacagcctgcaggactgtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcaggtaacacaagcctcatgtctctga

SEQ ID NO: 8777 - DNA, 1675 bp, Artificial Sequence
  Synthetic polypeptide
tactatagtttggatacttgtctccccaaacctcattgtgaaatgtgatccccagtgctggaggtggggcctaatggatggtggttgggtcatggggacagctccccatgagttcgttcttgctgtattagttccctccaaagctggttgttaaaaagaacctggtgcctccccctgtctctcttccttcctctcttaccatgtgatctggacacactggctccactttgccttctaccataagtggaatcagcctgaagcccccaccagaagcagatgcttgcgccatgcttcttgcacagcctgcaggactgtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcagttatctctaaagactcttcggtga

SEQ ID NO: 8778 - DNA, 1295 bp, Artificial Sequence
  Synthetic polypeptide
gccgggcacgatggctcacacctgtaaactcagcactttgggaggccaagcagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactga

SEQ ID NO: 8779 - DNA, 337 bp, Artificial Sequence; identical to SEQ ID NO: 6393
  Synthetic polypeptide

SEQ ID NO: 8780 - DNA, 116 bp, Artificial Sequence; identical to SEQ ID NO: 7598
  Synthetic polypeptide

SEQ ID NO: 8781 - DNA, 456 bp, Artificial Sequence; identical to SEQ ID NO: 6649
  Synthetic polypeptide

SEQ ID NO: 8782 - DNA, 480 bp, Artificial Sequence; identical to SEQ ID NO: 6650
  Synthetic polypeptide

SEQ ID NO: 8783 - DNA, 186 bp, Artificial Sequence; identical to SEQ ID NO: 6651
  Synthetic polypeptide

SEQ ID NO: 8784 - DNA, 1861 bp, Artificial Sequence; identical to SEQ ID NO: 6680
  Synthetic polypeptide

SEQ ID NO: 8785 - DNA, 1123 bp, Artificial Sequence; identical to SEQ ID NO: 6681
  Synthetic polypeptide

SEQ ID NO: 8786 - DNA, 566 bp, Artificial Sequence
  Synthetic polypeptide
gggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctga

SEQ ID NO: 8787 - DNA, 695 bp, Artificial Sequence
  Synthetic polypeptide
gggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttga

SEQ ID NO: 8788 - DNA, 2046 bp, Artificial Sequence
  Synthetic polypeptide
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8789 - DNA, 2100 bp, Artificial Sequence
  Synthetic polypeptide
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8790 - DNA, 2124 bp, Artificial Sequence
  Synthetic polypeptide
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcaaacggggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8791 - DNA, 2100 bp, Artificial Sequence
  Synthetic polypeptide
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcaaagccaagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8792 - DNA, 2016 bp, Artificial Sequence
  Synthetic polypeptide
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8793 - DNA, 2124 bp, Artificial Sequence
  Synthetic polypeptide
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8794 - DNA, 2007 bp, Artificial Sequence
  Synthetic polypeptide
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8795 - DNA, 663 bp, Artificial Sequence
  Synthetic polypeptide
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaa

SEQ ID NO: 8796 - DNA, 724 bp, Artificial Sequence
  Synthetic polypeptide
cttcctttccccgctgctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgataggactcgggacctgccaggcagggcggctgcggggctgcccctggccccccggcccctcctgggcgccctcgtcccgctcctggccctgctccctgtgttctgctag

SEQ ID NO: 8797 - DNA, 75 bp, Artificial Sequence
  Synthetic polypeptide
cttcctttccccgctgctcaccatcatcttcaagaacttccaggagtgtgtggaccagaaggtgtaccaggctga

SEQ ID NO: 8798 - DNA, 1475 bp, Artificial Sequence
  Synthetic polypeptide
ttatgttaaagaggcgatttttggaaagtcccagatagccactggatggggggctggttgccaggggaacaaacctggtgctctgagggttggaatttacaggcccacccctcacctctggggaagggagaggggatgaagattgagtagagcaccaattgccaatgatttaatcggtcatgcctgtgtaatgaagcctccataaaaatccaaaaggactgagtttgggggcttccaggaaggtgaacaagaacacatccacaggccaggagggtgcaaacccaacgccacagggcagcaactcctatgcgccggacccttctagagcttcccctcggtatctcttcatctggctgtttatttgtatcctttaaaatatcctttataacaaatggatgaacgtaagtaagtgtctccttgagttctgtgagctactctaacaaattaattgaacccaaggagcagtcctgagaacctcgatttatagctggttggtcagaggcacagataaaacaacctgaagcttgtgttggcattggaagtgggagagtcttgtgggactgagccttcactctgtgggatctgatgctatcttcaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtga

SEQ ID NO: 8799 - DNA, 216 bp, Artificial Sequence
  Synthetic polypeptide
ggagtctgtggactcctggttcaaatcctggctttgcactcaaggcaagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctag

SEQ ID NO: 8800 - DNA, 1185 bp, Artificial Sequence
  Synthetic polypeptide
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtga

SEQ ID NO: 8801 - DNA, 550 bp, Artificial Sequence
  Synthetic polypeptide
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtga

SEQ ID NO: 8802 - DNA, 387 bp, Artificial Sequence
  Synthetic polypeptide
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggaagctgctggactcactggcagagacctgggacttcttcttcagtga

SEQ ID NO: 8803 - DNA, 1713 bp, Artificial Sequence
  Synthetic polypeptide
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctag

SEQ ID NO: 8804 - DNA, 1950 bp, Artificial Sequence
  Synthetic polypeptide
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctag

SEQ ID NO: 8805 - DNA, 921 bp, Artificial Sequence
  Synthetic polypeptide
ggccggcgggcgggcgcccggcgcgggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctag

SEQ ID NO: 8806 - DNA, 1083 bp, Artificial Sequence; identical to SEQ ID NO: 7080
  Synthetic polypeptide

SEQ ID NO: 8807 - DNA, 243 bp, Artificial Sequence
  Synthetic polypeptide
ttctgtctccttctgccaggtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggtaagtaa

SEQ ID NO: 8808 - DNA, 1182 bp, Artificial Sequence
  Synthetic polypeptide
ttctgtctccttctgccaggtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 8809 - DNA, 1122 bp, Artificial Sequence
  Synthetic polypeptide
ttctgtctccttctgccaggtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 8810 - DNA, 336 bp, Artificial Sequence
  Synthetic polypeptide
ttctgtctccttctgccaggtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtga

SEQ ID NO: 8811 - DNA, 921 bp, Artificial Sequence
  Synthetic polypeptide
aacttccaagttttgagtaaaaatgatttctaacgttgcattctgcccagaaagttaccaattaaatgtggagtagagcaaagactgtttaaaacatcctgtcccccaaatttaatttccctgtacttcatctcaggaagctactggagtgtggtgtctaccacaacaagggagtactctaagaaggaggatcagatccagggaagaggggctcccatacaagacaggggagcagaatccccaggaagttgacaggtgcaagtcccaggacagcagtgtcacagaagacctggaaagcagccaattatggagagtcgcctccagggaaagcaaagtcatagtagatttgaccatgtggaaaatcttatcgagagactttttacagagctgttgccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaa

SEQ ID NO: 8812 - DNA, 1164 bp, Artificial Sequence; identical to SEQ ID NO: 7133
  Synthetic polypeptide

SEQ ID NO: 8813 - DNA, 376 bp, Artificial Sequence; identical to SEQ ID NO: 7134
  Synthetic polypeptide

SEQ ID NO: 8814 - DNA, 2578 bp, Artificial Sequence; identical to SEQ ID NO: 7194
  Synthetic polypeptide

SEQ ID NO: 8815 - DNA, 2305 bp, Artificial Sequence; identical to SEQ ID NO: 7195
  Synthetic polypeptide

SEQ ID NO: 8816 - DNA, 1759 bp, Artificial Sequence; identical to SEQ ID NO: 7196
  Synthetic polypeptide

SEQ ID NO: 8817 - DNA, 1320 bp, Artificial Sequence
  Synthetic polypeptide
ggccgggtgcagtggctcacgcctgtaatcccagcactttggatggcctagggtgggtggatcacttcaggccaggagttcgagaccatcctggccaacatggcgaaactccgtctctactaaaaatacaaaaattagctggatgtggtggtgcacacctgtattcccagctactcaggaggctgaggcaggagaattgctcaaacctgggagacagaggttgtaatgagccaagatcgcaccattgcactccagcctcggtgacagagcaggactccatctcaaaaaaaaaaaaaaggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctag

SEQ ID NO: 8818 - DNA, 420 bp, Artificial Sequence
  Synthetic polypeptide
ggccgggtgcagtggctcacgcctgtaatcccagcactttggatggcctagggtgggtggatcacttcaggccaggagttcgagaccatcctggccaacatggcgaaactccgtctctactaaaaatacaaaaattagctggatgtggtggtgcacacctgtattcccagctactcaggaggctgaggcaggagaattgctcaaacctgggagacagaggttgtaatgagccaagatcgcaccattgcactccagcctcggtgacagagcaggactccatctcaaaaaaaaaaaaaaggggtctccgtccacgtgtgcaatgagcaccgttatgggtacatgaatgtgccggtgaaatcccaccaggggctggaagacgagagggtcaacttcatccacctgatcttagaagcactaggt

SEQ ID NO: 8819 - DNA, 998 bp, Artificial Sequence
  Synthetic polypeptide
gggacatgactgctgccttgaaacagaagaggggaaatcgtgggacagagaggacatgctgctttggggaaaccactgaaggcagagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtga

SEQ ID NO: 8820 - DNA, 1130 bp, Artificial Sequence
  Synthetic polypeptide
acatggagagtggaactaggaatttctccatttccactgaagactgaacaaagggagatactgcaggggtcggggagaggttagagctctggaggacttccgtgcacaggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactga

SEQ ID NO: 8821 - DNA, 1280 bp, Artificial Sequence
  Synthetic polypeptide
acatggagagtggaactaggaatttctccatttccactgaagactgaacaaagggagatactgcaggggtcggggagaggttagagctctggaggacttccgtgcacaggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactga

SEQ ID NO: 8822 - DNA, 1277 bp, Artificial Sequence
  Synthetic polypeptide
acatggagagtggaactaggaatttctccatttccactgaagactgaacaaagggagatactgcaggggtcggggagaggttagagctctggaggacttccgtgcacaggatgaacaggccgatccaggtcaagccagccgacagcgagagccgaggagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactga

SEQ ID NO: 8823 - DNA, 805 bp, Artificial Sequence
  Synthetic polypeptide
cggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctag

SEQ ID NO: 8824 - DNA, 3042 bp, Artificial Sequence
  Synthetic polypeptide
tgatatggtttggatttgtgtccctgcccaaatcacatgtcgaattgtaatccccactgttggaggaggggcctaatgggaggtgattggatcaaggagggattccacccttactgttctcataataatgagttctcatgagtcctggttgtttgaacatgtgtcgcatctcccctttctctctcttcctcctgctccagctgtgtgggacgtgcctgctttgccttcgccttccaccatgatctctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaa

SEQ ID NO: 8825 - DNA, 746 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctga

SEQ ID NO: 8826 - DNA, 692 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctga

SEQ ID NO: 8827 - DNA, 671 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagaaagtgagcaaggtcgtagaacttccctag

SEQ ID NO: 8828 - DNA, 656 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaaggtgtggctactgtga

SEQ ID NO: 8829 - DNA, 716 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgtgtctgcagcttctcttctag

SEQ ID NO: 8830 - DNA, 701 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggatga

SEQ ID NO: 8831 - DNA, 707 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgcttctcttctag

SEQ ID NO: 8832 - DNA, 635 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctga

SEQ ID NO: 8833 - DNA, 1100 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagaaaagacagactgtcaagcaaggaccgaaagcctggccttaa

SEQ ID NO: 8834 - DNA, 731 bp, Artificial Sequence
  Synthetic polypeptide
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgttgtattccaacactccactcgctaagaggccctga

SEQ ID NO: 8835 - DNA, 29 bp, Artificial Sequence
  Synthetic polypeptide
agaccctgagcctaggaaccacagaataa

SEQ ID NO: 8836 - DNA, 546 bp, Artificial Sequence
  Synthetic polypeptide
agaccctgagcctaggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataa

SEQ ID NO: 8837 - DNA, 807 bp, Artificial Sequence
  Synthetic polypeptide
ggaggctcatgcctgtaatctcagctttgggagaccgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaa

SEQ ID NO: 8838 - DNA, 450 bp, Artificial Sequence
  Synthetic polypeptide
ggaggctcatgcctgtaatctcagctttgggagaccgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgctt

SEQ ID NO: 8839 - DNA, 1335 bp, Artificial Sequence
  Synthetic polypeptide
ggccgggcgcggtggctcacgccagtaatcccagcactttgggaggccgaagcgggctgattgcttgagcccagcagttcgagaccagcctggccaacatggcaaaacaccgtctctacaaaagaaaaatacaaaaattagccgagcgtggtggtggacgcctgttcagctactcaggaggccgagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaa

SEQ ID NO: 8840 - DNA, 22 bp, Artificial Sequence
  Synthetic polypeptide
ccagactgagcaagtggagtag

SEQ ID NO: 8841 - DNA, 3311 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaa

SEQ ID NO: 8842 - DNA, 1586 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattgatatgaatatgaatctacagtttcagtttcaggcaacttgtcctcaaacagtttcttgtgtatggaaaatggaacccagattttaa

SEQ ID NO: 8843 - DNA, 3044 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttggtaaaaatagttattttttcccacatcctatcagaacaatattattattattattttttattacactttaa

SEQ ID NO: 8844 - DNA, 1740 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcag

SEQ ID NO: 8845 - DNA, 1708 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaac

SEQ ID NO: 8846 - DNA, 1597 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctg

SEQ ID NO: 8847 - DNA, 1571 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcatt

SEQ ID NO: 8848 - DNA, 1562 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatg

SEQ ID NO: 8849 - DNA, 1518 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgatta

SEQ ID NO: 8850 - DNA, 1451 bp, Artificial Sequence
  Synthetic polypeptide
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattc

SEQ ID NO: 8851 - DNA, 497 bp, Artificial Sequence; identical to SEQ ID NO: 6379
  Synthetic polypeptide

SEQ ID NO: 8852 - DNA, 550 bp, Artificial Sequence
  Synthetic polypeptide
ctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtagagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctga

SEQ ID NO: 8853 - DNA, 301 bp, Artificial Sequence
  Synthetic polypeptide
ctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtagagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtga

SEQ ID NO: 8854 - DNA, 295 bp, Artificial Sequence
  Synthetic polypeptide
ctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtagagtgatcatcaccatgctggtcgccaccgccgtctgctgttacctcttttttcaggctgcaccctacacccatgaaattacaactctcgagatctgcacttgggaattcctgttgttcatgaatgcccccaggtga

SEQ ID NO: 8855 - DNA, 619 bp, Artificial Sequence
  Synthetic polypeptide
ctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtagagtgatcatcaccatgctggtcgccaccgccgtctgctgttacctcttctggctcatcgccatcctggcgcagctgaaccccctgttcgggccccagctgaagaatgagaccatctggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctga

SEQ ID NO: 8856 - DNA, 479 bp, Artificial Sequence
  Synthetic polypeptide
tgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactaggaacccttaacattcagggatgtggccatagaattctctccagaagagtggaaatgcctggaccctgcccagcagaatttgtatagagatgtgatgttggagaactacagaaacctggtctccctagaggaaggaacagagccacagagaaaaatgacttgctcacaacagaagagccagtag

SEQ ID NO: 8857 - DNA, 692 bp, Artificial Sequence
  Synthetic polypeptide
tgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactaggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaattttcctcgctgatctcttcatgccgtgtaatttcacatggactttcaagaggaaggaacagagccacagagaaaaatgacttgctcacaacagaagagccagtagtaaaacacaggtttgacttgcagtatccagaggaaatgtggagaaacacagttgtacagaagggaagaaaatag

SEQ ID NO: 8858 - DNA, 773 bp, Artificial Sequence
  Synthetic polypeptide
tgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactaggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaa

SEQ ID NO: 8859 - DNA, 77 bp, Artificial Sequence
  Synthetic polypeptide
ggctgagcacggtggctgatgcctgtaatcccagcattttgggaggccgaggttcactctttgaatttcctggataa

SEQ ID NO: 8860 - DNA, 3046 bp, Artificial Sequence; identical to SEQ ID NO: 7871
  Synthetic polypeptide

SEQ ID NO: 8861 - DNA, 741 bp, Artificial Sequence; identical to SEQ ID NO: 7872
  Synthetic polypeptide

SEQ ID NO: 8862 - DNA, 1463 bp, Artificial Sequence
  Synthetic polypeptide
aatccggatctgatgaaggcttcgagctaccttcttacaggactcttcagctccctgcgccttttaacacatgcacatccagcaaaagcagaggagaacctggctgtgattcaaagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaa

SEQ ID NO: 8863 - DNA, 170 bp, Artificial Sequence
  Synthetic polypeptide
aatccggatctgatgaaggcttcgagctaccttcttacaggactcttcagctccctgcgccttttaacacatgcacatccagcaaaagcagaggagaacctggctgtgattcaaagtgtgtgaacccagctctgtcccttgggttccgtacatataaatggagcagctga

SEQ ID NO: 8864 - DNA, 239 bp, Artificial Sequence
  Synthetic polypeptide
aatccggatctgatgaaggcttcgagctaccttcttacaggactcttcagctccctgcgccttttaacacatgcacatccagcaaaagcagaggagaacctggctgtgattcaaagagtctcactctactgcccaggctggagtgcagtggtacaatcttggctcactgcagcctccgccttccgggttccagtgatcctcctgcctcagcctcccaagtagctgagattacagcgtga

SEQ ID NO: 8865 - DNA, 1219 bp, Artificial Sequence
  Synthetic polypeptide
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttag

SEQ ID NO: 8866 - DNA, 1585 bp, Artificial Sequence
  Synthetic polypeptide
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 8867 - DNA, 1324 bp, Artificial Sequence
  Synthetic polypeptide
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttag

SEQ ID NO: 8868 - DNA, 1006 bp, Artificial Sequence
  Synthetic polypeptide
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaggccccacctcctacggcatctgctagctcgtctacccctgttccattgtctccaccagatacaacttggcctcttcctgcccttgcaaccacagaaccagctaaaaacattgcacagaatcactgctgtaacatgttccaagctggtcttcataatgctctaatgaagtaa

SEQ ID NO: 8869 - DNA, 1585 bp, Artificial Sequence
  Synthetic polypeptide
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 8870 - DNA, 414 bp, Artificial Sequence; identical to SEQ ID NO: 6481
  Synthetic polypeptide

SEQ ID NO: 8871 - DNA, 375 bp, Artificial Sequence
  Synthetic polypeptide
agcctggactctgcagtcgctgacaggattcaagtcctgactgccacaagattctcccagatgcttcaggacaagcccctgcgcacatcgtggcagcggaagatgaaggaacgacaggagaggaagctggccaaggactttgcccgtcacctggaggaggagaaggagaggcgccgccaggagaagaaacagcgccgggctgagaacctgaaacgccgcctggagaatgagcggaaggcagaggtcgtccaagtgatccgaaaccccgccaagctcaagcgggcaaagaagaagcagctgcgctccattgagaagcgggacaccctggccctgctgcagaagcagccgccccagcagccggcagccaagatctga

SEQ ID NO: 8872 - DNA, 603 bp, Artificial Sequence
  Synthetic polypeptide
tgtgatggttaataatgtgtcaacttgattggattgaaggatacagagtattgttcctgggtgtgtctgtgagggtgttgccaaaggagattaacatttcagtcagtggactgggagacgcagactcatcctcaatgtgggtgggcaccatccaatcacctgccagcgtgggcagaataaagcaggcagaagaaggtggaatgagcagacctgctgagttttctggccttcatctttctcccatgctggatgcttcctgccctcaaacatcaggccccaaattcttcagcttttggactcttggacatacatcagtggatcgccagggattctccggccttcggccacaggctgaaggctgcgctgtcggcttccctacttttgaggttttgggactcagactggcttccttgctcttcagcttgcagatggcctgctgtgggacttcacctggtgaccgtatatgaagcatcaacaaacgaattgattaatgaagagttgggaatagcttatccaatcattgatgggatccctaatatgataccacaggcagctaggatgacacgtcaaagtaagaagcaagaagaagtggagcagcgctag

SEQ ID NO: 8873 - DNA, 932 bp, Artificial Sequence
  Synthetic polypeptide
ccctgctccatgttcttagcatcctaggttcgtttccttcttggcactcaccgtggcttgaaatcacatggatttatgtgattatttgagtatgcctttccccactaaactgtcagcttcatgaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataa

SEQ ID NO: 8874 - DNA, 863 bp, Artificial Sequence
  Synthetic polypeptide
ccctgctccatgttcttagcatcctaggttcgtttccttcttggcactcaccgtggcttgaaatcacatggatttatgtgattatttgagtatgcctttccccactaaactgtcagcttcatgaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaa

SEQ ID NO: 8875 - DNA, 386 bp, Artificial Sequence
  Synthetic polypeptide
ccctgctccatgttcttagcatcctaggttcgtttccttcttggcactcaccgtggcttgaaatcacatggatttatgtgattatttgagtatgcctttccccactaaactgtcagcttcatgaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggca

SEQ ID NO: 8876 - DNA, 2075 bp, Artificial Sequence
  Synthetic polypeptide
cagtgttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattga

SEQ ID NO: 8877 - DNA, 1901 bp, Artificial Sequence
  Synthetic polypeptide
cagtgttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattga

SEQ ID NO: 8878 - DNA, 977 bp, Artificial Sequence; identical to SEQ ID NO: 7082
  Synthetic polypeptide

SEQ ID NO: 8879 - DNA, 1592 bp, Artificial Sequence; identical to SEQ ID NO: 7083
  Synthetic polypeptide

SEQ ID NO: 8880 - DNA, 185 bp, Artificial Sequence
  Synthetic polypeptide
cagtggttcttagcccttgctgcacaacagatttacttggggagtaaataccaatatggaggcctccaaacagataattcaatgtaaatctcttgggggaggaggaaccatcactatatttaaatattccccaggaatgtaaaatgaagggcgtggtgtgcaccagaatctatgagaaggtctga

SEQ ID NO: 8881 - DNA, 142 bp, Artificial Sequence
  Synthetic polypeptide
cagtggttcttagcccttgctgcacaacagatttacttggggagtaaataccaatatggaggcctccaaacagataattcaatgtaaatctcttgggggaggaggaaccatcactatatttaaatattccccaggaatgtaa

SEQ ID NO: 8882 - DNA, 373 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgc

SEQ ID NO: 8883 - DNA, 383 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacag

SEQ ID NO: 8884 - DNA, 387 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccg

SEQ ID NO: 8885 - DNA, 412 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgc

SEQ ID NO: 8886 - DNA, 606 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctga

SEQ ID NO: 8887 - DNA, 500 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggccctggcgtgacgcacgtgatagtgcggga

SEQ ID NO: 8888 - DNA, 526 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgccc

SEQ ID NO: 8889 - DNA, 555 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagcc

SEQ ID NO: 8890 - DNA, 490 bp, Artificial Sequence
  Synthetic polypeptide
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggtaagtctccagcgtgccccg

SEQ ID NO: 8891 - DNA, 3034 bp, Artificial Sequence
  Synthetic polypeptide
cccaccattctttaattttgttcataattctatggttggggaatctggatattaaattttctaggctctgtttccagctggtttcttaagttatatccataggagacactgggagaagacaggaaggcaggaagagaggagatgctattgtagtgtgacatctttctttctctttctggtagcacctctggatttagatgcactccttcaaggaccatgggttctgcaacagtaccccctctccattgttccagctctgactcagatgggccctccttgatggcactcccagcagcacagccttagcactgggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 8892 - DNA, 1314 bp, Artificial Sequence
  Synthetic polypeptide
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 8893 - DNA, 1374 bp, Artificial Sequence
  Synthetic polypeptide
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 8894 - DNA, 157 bp, Artificial Sequence
  Synthetic polypeptide
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtga

SEQ ID NO: 8895 - DNA, 490 bp, Artificial Sequence
  Synthetic polypeptide
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcaca

SEQ ID NO: 8896 - DNA, 1497 bp, Artificial Sequence
  Synthetic polypeptide
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 8897 - DNA, 1191 bp, Artificial Sequence
  Synthetic polypeptide
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 8898 - DNA, 1045 bp, Artificial Sequence
  Synthetic polypeptide
ggcctccacatacagttgctcagggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctga

SEQ ID NO: 8899 - DNA, 962 bp, Artificial Sequence
  Synthetic polypeptide
tagtatagtgctgaaaagtgtgggccctggagaatgtgtgttctgatcctgtctgttagttcttaccagctgggtgactttcagttttaaactcccttaaaccacagctctttatctgtaaatagggatggtaactgtacttagcctcttaggagtttcaaggattcagtggaacaatccaggcaaagtgcttggccaggacctggcacaagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctga

SEQ ID NO: 8900 - DNA, 887 bp, Artificial Sequence
  Synthetic polypeptide
tagtatagtgctgaaaagtgtgggccctggagaatgtgtgttctgatcctgtctgttagttcttaccagctgggtgactttcagttttaaactcccttaaaccacagctctttatctgtaaatagggatggtaactgtacttagcctcttaggagtttcaaggattcagtggaacaatccaggcaaagtgcttggccaggacctggcacaagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggtaa

SEQ ID NO: 8901 - DNA, 559 bp, Artificial Sequence
  Synthetic polypeptide
tgtggtaggctgaataaggcccccaccaaagatgtccttttcctaatccccagaacctgtgaatagcttacattacacggcaacagggactttgcagatgtggttaaggtaacagatttttagatgaggggattatcctggattatcgggtaggctcaaaataattacatgatcctttaaaagcagagaacatttcccgacgaaagtcagagagatgaggcctcgtgagaaggattccacacactcacactctcgctggctctgagatgtaggtgcccttgtgcaagaatcagagagaggctgcaaggagccagtggcagttcccgccgacagcccgcagggaagcagggacctcagtccatcaggcaaattgaactgaattccgccaacaaggcgcagaggcctggaaacagatgcttcattagagcctctaggagggagtacagcctggccaacaccttgatttcagccctgtgaggcttgaagcccacacaccagccgcgcccactggacttctaacctacagaactgtgagcttcaactcctggctaatgagtga

SEQ ID NO: 8902 - DNA, 949 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtga

SEQ ID NO: 8903 - DNA, 946 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttag

SEQ ID NO: 8904 - DNA, 967 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctag

SEQ ID NO: 8905 - DNA, 394 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggagtaccaggacctgctcaatgtcaagctggccctggacatcgagatcgccacctacaggaagctgctagagggcgaggagaaccggatcaccattcccgtgcagaccttctccaacctgcagatt

SEQ ID NO: 8906 - DNA, 435 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctg

SEQ ID NO: 8907 - DNA, 197 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggccc

SEQ ID NO: 8908 - DNA, 1391 bp, Artificial Sequence
  Synthetic polypeptide
caaaagacgagattccagtccgagccctgtcctcaacttgctgtatgaccttgggaattgctagccctcgacgtttcggcatctgcaggatctggattagaaactcggagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtag

SEQ ID NO: 8909 - DNA, 581 bp, Artificial Sequence
  Synthetic polypeptide
ctgccttgaacgctgaagttgtatctggagttgtagccgccactttgaggccatgaggaggaatgggagagtgcaaagatacagagtctgggccttgatggcatcaagtggtcagaccaactccagtagctgtcttcctcagatttctgttagtgagaaaagtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatga

SEQ ID NO: 8910 - DNA, 564 bp, Artificial Sequence
  Synthetic polypeptide
ctgccttgaacgctgaagttgtatctggagttgtagccgccactttgaggccatgaggaggaatgggagagtgcaaagatacagagtctgggccttgatggcatcaagtggtcagaccaactccagtagctgtcttcctcagatttctgttagtgagaaaagtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcga

SEQ ID NO: 8911 - DNA, 1011 bp, Artificial Sequence
  Synthetic polypeptide
tgcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtga

SEQ ID NO: 8912 - DNA, 173 bp, Artificial Sequence
  Synthetic polypeptide
cttttctcttttcttctcctaccccaattcgtccctggacttggtgaagttccacctccttcctgaagtcctcaatgattctccaaaccatgcttgctcctgagaccaaggctgtcattcattggattatggatattccttttgtgctttctgccaatctccatggaggagac

SEQ ID NO: 8913 - DNA, 198 bp, Artificial Sequence
  Synthetic polypeptide
cttttctcttttcttctcctaccccaattcgtccctggacttggtgaagttccacctccttcctgaagtcctcaatgattctccaaaccatgcttgctcctgagaccaaggctgtcattcattggattatggatattccttttgtgctttctgccaatctccatggaggagaccttgtggccaattatccatatgatg

SEQ ID NO: 8914 - DNA, 851 bp, Artificial Sequence
  Synthetic polypeptide
cttttctcttttcttctcctaccccaattcgtccctggacttggtgaagttccacctccttcctgaagtcctcaatgattctccaaaccatgcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaa

SEQ ID NO: 8915 - DNA, 227 bp, Artificial Sequence
  Synthetic polypeptide
cttttctcttttcttctcctaccccaattcgtccctggacttggtgaagttccacctccttcctgaagtcctcaatgattctccaaaccatgcttgctcctgagaccaaggctgtcattcattggattatggatattccttttgtgctttctgccaatctccatggaggagaccttgtggccaattatccatatgatgagacgcggagtggtagtgctcacgaatac

SEQ ID NO: 8916 - DNA, 345 bp, Artificial Sequence
  Synthetic polypeptide
gttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggaaatgaaacacgatttccaaaatgaacttaatctttcatga

SEQ ID NO: 8917 - DNA, 330 bp, Artificial Sequence; identical to SEQ ID NO: 7604
  Synthetic polypeptide

SEQ ID NO: 8918 - DNA, 678 bp, Artificial Sequence
  Synthetic polypeptide
cacattgatctgttagcaaatcctctcagctctgccttcaattatgttaatagtctgtctagtttcttaccacctccactgctactatgcttaccacatccagcctgtattattgcaattgcctcctaattgctctccctgcttctaccttatcccctactcccacagcttattttctgtaacatagatgccaaagcaatcctgttaaaatgtgagtcagattatggcactgctcttaaaaccttccaatgtcttctcatttctctcagtaaaagccaaactccttacaatgcctgtaggccttacacgatctgtcctcccataacctctgacttactcacgtgcttttctcccaccaatccactccaaccacattgggtttttttctgttcctggaacacactgaacacacactaatagcactgttctttcctctgtctgaaacactttcctcagttatcccaagccttctttcacgtccttcaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggtgcctcttgtatga

SEQ ID NO: 8919 - DNA, 726 bp, Artificial Sequence
  Synthetic polypeptide
cacattgatctgttagcaaatcctctcagctctgccttcaattatgttaatagtctgtctagtttcttaccacctccactgctactatgcttaccacatccagcctgtattattgcaattgcctcctaattgctctccctgcttctaccttatcccctactcccacagcttattttctgtaacatagatgccaaagcaatcctgttaaaatgtgagtcagattatggcactgctcttaaaaccttccaatgtcttctcatttctctcagtaaaagccaaactccttacaatgcctgtaggccttacacgatctgtcctcccataacctctgacttactcacgtgcttttctcccaccaatccactccaaccacattgggtttttttctgttcctggaacacactgaacacacactaatagcactgttctttcctctgtctgaaacactttcctcagttatcccaagccttctttcacgtccttcaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtag

SEQ ID NO: 8920 - DNA, 1004 bp, Artificial Sequence
  Synthetic polypeptide
ctgttttccttaggggactgtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctga

SEQ ID NO: 8921 - DNA, 887 bp, Artificial Sequence
  Synthetic polypeptide
ctgttttccttaggggactgtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccagaaaacgctgccgcggtccacagtgtcgattctggatgaccacattagccactatccacagctag

SEQ ID NO: 8922 - DNA, 355 bp, Artificial Sequence; identical to SEQ ID NO: 8039
  Synthetic polypeptide

SEQ ID NO: 8923 - DNA, 80 bp, Artificial Sequence; identical to SEQ ID NO: 6364
  Synthetic polypeptide

SEQ ID NO: 8924 - DNA, 217 bp, Artificial Sequence; identical to SEQ ID NO: 6365
  Synthetic polypeptide

SEQ ID NO: 8925 - DNA, 523 bp, Artificial Sequence
  Synthetic polypeptide
agtcccacagatcaaagggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 8926 - DNA, 900 bp, Artificial Sequence
  Synthetic polypeptide
gctctgccattcactacccttccagattctgagcaaattaagttacattcccttttggagcctcagggtcctcaccgcagaatgtgagatcacggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataa

SEQ ID NO: 8927 - DNA, 831 bp, Artificial Sequence
  Synthetic polypeptide
gctctgccattcactacccttccagattctgagcaaattaagttacattcccttttggagcctcagggtcctcaccgcagaatgtgagatcacggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaa

SEQ ID NO: 8928 - DNA, 354 bp, Artificial Sequence
  Synthetic polypeptide
gctctgccattcactacccttccagattctgagcaaattaagttacattcccttttggagcctcagggtcctcaccgcagaatgtgagatcacggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggca

SEQ ID NO: 8929 - DNA, 1082 bp, Artificial Sequence
  Synthetic polypeptide
ggccaggcatggtggctcatgcctgtgatccgagtgttttggatgctgaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataa

SEQ ID NO: 8930 - DNA, 588 bp, Artificial Sequence
  Synthetic polypeptide
ggccaggcatggtggctcatgcctgtgatccgagtgttttggatgctgaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctag

SEQ ID NO: 8931 - DNA, 763 bp, Artificial Sequence; identical to SEQ ID NO: 606
  Synthetic polypeptide

SEQ ID NO: 8932 - DNA, 1084 bp, Artificial Sequence; identical to SEQ ID NO: 580
  Synthetic polypeptide

SEQ ID NO: 8933 - DNA, 1367 bp, Artificial Sequence
  Synthetic polypeptide
tggtggttaagttggagcctgacctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 8934 - DNA, 1406 bp, Artificial Sequence
  Synthetic polypeptide
tggtggttaagttggagcctgacctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 8935 - DNA, 399 bp, Artificial Sequence
  Synthetic polypeptide
tggtggttaagttggagcctgacctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggcca

SEQ ID NO: 8936 - DNA, 1595 bp, Artificial Sequence; identical to SEQ ID NO: 851
  Synthetic polypeptide

SEQ ID NO: 8937 - DNA, 1433 bp, Artificial Sequence; identical to SEQ ID NO: 852
  Synthetic polypeptide

SEQ ID NO: 8938 - DNA, 414 bp, Artificial Sequence
  Synthetic polypeptide
gggatcccagaacagaaaaatgacattgagggacaatgaggaaacctggataattaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattag

SEQ ID NO: 8939 - DNA, 139 bp, Artificial Sequence
  Synthetic polypeptide
tggcagagtagagccagcctgggtgctggagtcagactgcagacttggttccctgctcgtcccagttctgctgcctgcggacaagttatttcagctctcttagctccacatgatttttttcatctgtcaggtactctga

SEQ ID NO: 8940 - DNA, 368 bp, Artificial Sequence
  Synthetic polypeptide
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtg

SEQ ID NO: 8941 - DNA, 2192 bp, Artificial Sequence
  Synthetic polypeptide
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctga

SEQ ID NO: 8942 - DNA, 1328 bp, Artificial Sequence
  Synthetic polypeptide
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggcaggtccatggccaacctctctgtcctgtttgggcaggtggtccgggggctgagtgcaggtgcccgggtctttga

SEQ ID NO: 8943 - DNA, 2117 bp, Artificial Sequence
  Synthetic polypeptide
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggctgggacacatgaagagctcctgaagaaaggcgggctatacgccgagctcatccggaggcaggccctggatgccccgaggacagcggccccaccgcccaaaaagccagaaggccccaggagccaccagcacaagtcctga

SEQ ID NO: 8944 - DNA, 1265 bp, Artificial Sequence
  Synthetic polypeptide
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaagggacgtcctctaa

SEQ ID NO: 8945 - DNA, 1331 bp, Artificial Sequence
  Synthetic polypeptide
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaagcttcctccgtgttgcaccctgtccgaattcccttccgctgcaggctgtgacattccatgcatggaaggaccatccttga

SEQ ID NO: 8946 - DNA, 413 bp, Artificial Sequence
  Synthetic polypeptide
tttggcgtgcaacatggggcttgagaaagggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggaatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtag

SEQ ID NO: 8947 - DNA, 599 bp, Artificial Sequence
  Synthetic polypeptide
tttggcgtgcaacatggggcttgagaaagggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtga

SEQ ID NO: 8948 - DNA, 289 bp, Artificial Sequence; identical to SEQ ID NO: 7343
  Synthetic polypeptide

SEQ ID NO: 8949 - DNA, 246 bp, Artificial Sequence; identical to SEQ ID NO: 7344
  Synthetic polypeptide

SEQ ID NO: 8950 - DNA, 149 bp, Artificial Sequence; identical to SEQ ID NO: 7345
  Synthetic polypeptide

SEQ ID NO: 8951 - DNA, 89 bp, Artificial Sequence; identical to SEQ ID NO: 7346
  Synthetic polypeptide

SEQ ID NO: 8952 - DNA, 80 bp, Artificial Sequence; identical to SEQ ID NO: 7347
  Synthetic polypeptide

SEQ ID NO: 8953 - DNA, 271 bp, Artificial Sequence
  Synthetic polypeptide
gagctcttggcttccatacgtgtctcagacagaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttga

SEQ ID NO: 8954 - DNA, 60 bp, Artificial Sequence
  Synthetic polypeptide
gagctcttggcttccatacgtgtctcagacagaatcatctcccctgccccacaaacatga

SEQ ID NO: 8955 - DNA, 254 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaaggtaaggggccgaggtcagctggcggctccagtcctgaaggcggagaagattctgacagagaagatggaaattactgccctcctgtcaagcgagaaagaacatcctctttaa

SEQ ID NO: 8956 - DNA, 1754 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatag

SEQ ID NO: 8957 - DNA, 1769 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatag

SEQ ID NO: 8958 - DNA, 290 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaagaaaatttctggaaggaatga

SEQ ID NO: 8959 - DNA, 1550 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatag

SEQ ID NO: 8960 - DNA, 1565 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatag

SEQ ID NO: 8961 - DNA, 588 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggtttttgctctgtcacccaggctggagtgcagtg

SEQ ID NO: 8962 - DNA, 243 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaa

SEQ ID NO: 8963 - DNA, 287 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcaggcgccttccaggcctgctga

SEQ ID NO: 8964 - DNA, 255 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctag

SEQ ID NO: 8965 - DNA, 392 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcaggggaagaagaaaagactcttcctttgaacccagaaggaatcccctga

SEQ ID NO: 8966 - DNA, 421 bp, Artificial Sequence
  Synthetic polypeptide
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgt

SEQ ID NO: 8967 - DNA, 252 bp, Artificial Sequence; identical to SEQ ID NO: 8153
  Synthetic polypeptide

SEQ ID NO: 8968 - DNA, 989 bp, Artificial Sequence
  Synthetic polypeptide
actgggagaggggggatcttgactgacattttagatcctgtctgctgctcactgattatgactgtggacgcgtctccctgcttctctgggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctga

SEQ ID NO: 8969 - DNA, 174 bp, Artificial Sequence
  Synthetic polypeptide
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttttatatacaaggaaaaccaaactaa

SEQ ID NO: 8970 - DNA, 861 bp, Artificial Sequence
  Synthetic polypeptide
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttga

SEQ ID NO: 8971 - DNA, 846 bp, Artificial Sequence
  Synthetic polypeptide
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctggtggtgaggtcgaagctgcaccggacctcacggcagcacagagccaaggagccaggggcctttggctttcagagaagagagaagcaggaggccctggagagagtgtcctcagcttcggtaccgacgccctaccattaccggtgggagcccagagagtga

SEQ ID NO: 8972 - DNA, 690 bp, Artificial Sequence
  Synthetic polypeptide
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgtaa

SEQ ID NO: 8973 - DNA, 879 bp, Artificial Sequence
  Synthetic polypeptide
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttga

SEQ ID NO: 8974 - DNA, 154 bp, Artificial Sequence
  Synthetic polypeptide
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctga

SEQ ID NO: 8975 - DNA, 1593 bp, Artificial Sequence; identical to SEQ ID NO: 870
  Synthetic polypeptide

SEQ ID NO: 8976 - DNA, 1431 bp, Artificial Sequence; identical to SEQ ID NO: 871
  Synthetic polypeptide

SEQ ID NO: 8977 - DNA, 147 bp, Artificial Sequence
  Synthetic polypeptide
ttggagttaaccatcccgggcgaaggaaaatcacctcggcagtgtttgaaggaaggatactgcaactctttgaagtacgcattttttgagtgtaaaagatcagtgttggataacagggcaagattcagaggaagaaaaggatattga

SEQ ID NO: 8978 - DNA, 144 bp, Artificial Sequence
  Synthetic polypeptide
ttggagttaaccatcccgggcgaaggaaaatcacctcggcagtgtttgaaggaaggatactgcaactctttgaagtacgcattttttgagtgtaaaagatcagtgatggagtctcgctctgttgcccgggctggagtgcagtag

SEQ ID NO: 8979 - DNA, 1975 bp, Artificial Sequence
  Synthetic polypeptide
ggccagatgcagtggttcatgcctgtaatctcagcactttgggaggccgaggcaggcggatcacctgaggtcaggagtttgagaccagcctggccaacgtggtgaaaccctgtctctactaaaaatacaaaaattagctgggcatggtggcaggtgcctgtaatcccagctactcgggaggctgaggcaggagaatcgcttgaacccaggaggtggaggttgcagtgaaccgagatcacaccactacagtacagctgggaaggtggaggatctgcagttccgcgtggaggaggagtccatcaccaagggagacctggagctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactga

SEQ ID NO: 8980 - DNA, 2080 bp, Artificial Sequence
  Synthetic polypeptide
ggccagatgcagtggttcatgcctgtaatctcagcactttgggaggccgaggcaggcggatcacctgaggtcaggagtttgagaccagcctggccaacgtggtgaaaccctgtctctactaaaaatacaaaaattagctgggcatggtggcaggtgcctgtaatcccagctactcgggaggctgaggcaggagaatcgcttgaacccaggaggtggaggttgcagtgaaccgagatcacaccactacagtacagctgggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactga

SEQ ID NO: 8981 - DNA, 622 bp, Artificial Sequence
  Synthetic polypeptide
gaccaggtgcagtgactcacacctgcaattccagagctttgggaggctgtggatcacatgaagctaagagttcaagaccagcctgggcaacataacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctag

SEQ ID NO: 8982 - DNA, 575 bp, Artificial Sequence
  Synthetic polypeptide
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtga

SEQ ID NO: 8983 - DNA, 362 bp, Artificial Sequence
  Synthetic polypeptide
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgct

SEQ ID NO: 8984 - DNA, 311 bp, Artificial Sequence
  Synthetic polypeptide
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaa

SEQ ID NO: 8985 - DNA, 416 bp, Artificial Sequence
  Synthetic polypeptide
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacagattggaaattaattgctatcaatgcgaatgatcctgaagcctcaaagtttcatggtctcagaaatattccagtatatacaataaatcgcatagtcatcctgccttcacttgacaggagccaaacttccagcctgtcctacctgcctgcacatcaggattcctgtgtgcccctggatgcagccctacatgttgttttgtatttttgttccctcttgggtctacaaagttacttatcttgtttttga

SEQ ID NO: 8986 - DNA, 172 bp, Artificial Sequence
  Synthetic polypeptide
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacaga

SEQ ID NO: 8987 - DNA, 2157 bp, Artificial Sequence; identical to SEQ ID NO: 6426
  Synthetic polypeptide

SEQ ID NO: 8988 - DNA, 799 bp, Artificial Sequence; identical to SEQ ID NO: 6427
  Synthetic polypeptide

SEQ ID NO: 8989 - DNA, 336 bp, Artificial Sequence; identical to SEQ ID NO: 6428
  Synthetic polypeptide

SEQ ID NO: 8990 - DNA, 126 bp, Artificial Sequence
  Synthetic polypeptide
ggctgggcacagtggctcatgcctttaatcccagcccttgaggtcaggagttcgagaccgcaagccaacatgggtaatctacagttgctgcagaactgcctggcagtgttaaatggagacacataa

SEQ ID NO: 8991 - DNA, 263 bp, Artificial Sequence
  Synthetic polypeptide
taggaggaagaacacatggtttctggtcatactctgtcaagaagtagatatgtaacatattgggcatttaacttaaaaattctaagtcatgttttctttttccactataagattgtactaggtgatataaagttcatgtcacttaaaattcaacgactgtttaccgagctgatacccagacataccagccttataacaaagactggattaaagagaagatctacgtgctccttcgtcggcaggcccaacaggctgggaaataa

SEQ ID NO: 8992 - DNA, 466 bp, Artificial Sequence
  Synthetic polypeptide
tgaactttgcagttttcctcaactgtaaaatggggatgacagtgcatgagggtgttgtgaggatcaaatgaaataaagcatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaa

SEQ ID NO: 8993 - DNA, 198 bp, Artificial Sequence
  Synthetic polypeptide
aatatctccagttttcctttccagctcaggataggcttccacttcccagtctgctttggttaggtgtggccacatgccttgccttggccagtgaagtgaacagaagtgaggtgcatcacttcctggaagaagccataagaaccggcagccagatctgccagtgagcctcaggctttaggaactgaagagtgtttctga

SEQ ID NO: 8994 - DNA, 461 bp, Artificial Sequence
  Synthetic polypeptide
gaggctgaggagggaggatcgcttgagctgaggagttcaaggctgcagtgagctatgatggtgccactgcacaccagcctagatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattag

SEQ ID NO: 8995 - DNA, 404 bp, Artificial Sequence
  Synthetic polypeptide
gaggctgaggagggaggatcgcttgagctgaggagttcaaggctgcagtgagctatgatggtgccactgcacaccagcctagatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagactgtgcttgcattggagactgagcaaaaggaaatgtgaaacgaataacatgatggaatatgtcatcctcatagaatttttaccaaagacaccgatttttcgaccagattag

SEQ ID NO: 8996 - DNA, 377 bp, Artificial Sequence
  Synthetic polypeptide
gaggctgaggagggaggatcgcttgagctgaggagttcaaggctgcagtgagctatgatggtgccactgcacaccagcctagatttggactgagcaacaaatttgaatctgaattcccttcttcattaactggaaaagtagctcctgaagaatttaaagccagcatcaacagagttaacagttgtcttaagaagaaccttcctgttaatacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattag

SEQ ID NO: 8997 - DNA, 1583 bp, Artificial Sequence; identical to SEQ ID NO: 828
  Synthetic polypeptide

SEQ ID NO: 8998 - DNA, 1421 bp, Artificial Sequence; identical to SEQ ID NO: 829
  Synthetic polypeptide

SEQ ID NO: 8999 - DNA, 1912 bp, Artificial Sequence
  Synthetic polypeptide
ttaaaaaaatgccaggcctccaccattccacacccccacccccaggatcagtcgaaaaccaggaggaaattctccctacaatgaaaaggtaggcaagaggaccccagcatcccccatcaacaccacctcagatagctacagtccactggggtctcctgcagtcctcacagacactaagcctgccggagggagctatctacctagagtccacacggctgtactccccctagaaagagctgacactgtgccttgcccctgtggcccatgcagctactgccctatgtcattttgaaaagggaactaatgctggagaatattgctctggcggtgagtagccacagcaccccttatccctgagcctaaactacaattaaaccacccatacctgatggctcagcatccccaaaccaagcttcaggcaactgtcacactcttcttggtggtaccaagcagtgatgaaactgctccacctacccccgcatccccaaactggctacctcaggcaagaggtgaagctgcacactcccgcctggaaaatgatgctttgacagaacagcttcatctacctctgtcaacagtggctgcaccctgcctctagggcctaaactaaaactacacattatctgccagggacatagtgctttgatggagccctacataacagaaaaatggtgcctgggctgcctagaacactcaaggccccagggcctgagctgaaatggcacttcgtcccctggggaattggtgtctttgtcaagctgagcagctgtgtagtccaaaactgagctggtatagcactctgcattgcagggaaacagagcaatgactgagctgagacacctcaccctacaggccaaacaactctagtaatggaactggattacttccctagagtctgagctgctgagacacccctctccctggagagtacagtcattgctgtgcttttccctgtctcctaaggccaaaataacagctttgcttggcccttctggggtacttgctgccagtgcatctggcttcacagagtcagggatactaccaagccctaccatccccagagtatagaatcaccactatatggtgtttcatccccagggagctgagttgtcactgaaccttattggttcaggctcctgcatggcagctgtagctgacagtgacactgatggtgctgagctccccactggctttggctggggacacccgaccacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagttgagcctaaggtgactgtgtatcctgcaaggacccagaccctgcagcaccacaacctcctggtctgctctgtgaatggtttctatccaggcagcattgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctga

SEQ ID NO: 9000 - DNA, 578 bp, Artificial Sequence
  Synthetic polypeptide
ggccggcgcggtggctcacacctgtaatcccagcactttgggaggccgagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatga

SEQ ID NO: 9001 - DNA, 590 bp, Artificial Sequence
  Synthetic polypeptide
ggccggcgcggtggctcacacctgtaatcccagcactttgggaggccgagaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatga

SEQ ID NO: 9002 - DNA, 130 bp, Artificial Sequence
  Synthetic polypeptide
ggccggcgcggtggctcacacctgtaatcccagcactttgggaggccgagaaggagcttcaagagcagggggagatcagaatcgtccagctgggcttcgacttggatgcccatggaattatcttcactga

SEQ ID NO: 9003 - DNA, 67 bp, Artificial Sequence
  Synthetic polypeptide
ccaggtgcggtggttcacgcctgtaatcccagcactttgggaggcccagactgagcaagtggagtag

SEQ ID NO: 9004 - DNA, 427 bp, Artificial Sequence; identical to SEQ ID NO: 573
  Synthetic polypeptide

SEQ ID NO: 9005 - DNA, 74 bp, Artificial Sequence; identical to SEQ ID NO: 7010
  Synthetic polypeptide

SEQ ID NO: 9006 - DNA, 952 bp, Artificial Sequence; identical to SEQ ID NO: 8583
  Synthetic polypeptide

SEQ ID NO: 9007 - DNA, 87 bp, Artificial Sequence; identical to SEQ ID NO: 8584
  Synthetic polypeptide

SEQ ID NO: 9008 - DNA, 396 bp, Artificial Sequence
  Synthetic polypeptide
agggacatcagggatgaggatgaaggagggagggcactggagcctaagagaatcagctccaatatcgcttctgccccttccagacagtgtgactctgggcaagtagcttgccttctctgggctgcaacttctttccaccattgcaagaggcggcagcgtgagagggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctga

SEQ ID NO: 9009 - DNA, 393 bp, Artificial Sequence
  Synthetic polypeptide
agggacatcagggatgaggatgaaggagggagggcactggagcctaagagaatcagctccaatatcgcttctgccccttccagacagtgtgactctgggcaagtagcttgccttctctgggctgcaacttctttccaccattgcaagaggcggcagcgtgagagggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctga

SEQ ID NO: 9010 - DNA, 311 bp, Artificial Sequence
  Synthetic polypeptide
agggacatcagggatgaggatgaaggagggagggcactggagcctaagagaatcagctccaatatcgcttctgccccttccagacagtgtgactctgggcaagtagcttgccttctctgggctgcaacttctttccaccattgcaagaggcggcagcgtgagagggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtga

SEQ ID NO: 9011 - DNA, 423 bp, Artificial Sequence
  Synthetic polypeptide
agggacatcagggatgaggatgaaggagggagggcactggagcctaagagaatcagctccaatatcgcttctgccccttccagacagtgtgactctgggcaagtagcttgccttctctgggctgcaacttctttccaccattgcaagaggcggcagcgtgagagggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaa

SEQ ID NO: 9012 - DNA, 1012 bp, Artificial Sequence
  Synthetic polypeptide
gttcctggcttacagctcttataacccatgtaatttcctaagggactagagcaataatagtatgttttgttaaaatatttgaccttttgtccttggtttctgaaacagctccagaacagctccagagtgataaaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtga

SEQ ID NO: 9013 - DNA, 363 bp, Artificial Sequence; identical to SEQ ID NO: 7059
  Synthetic polypeptide

SEQ ID NO: 9014 - DNA, 465 bp, Artificial Sequence; identical to SEQ ID NO: 7060
  Synthetic polypeptide

SEQ ID NO: 9015 - DNA, 2104 bp, Artificial Sequence
  Synthetic polypeptide
agtggagtgggctggttgtggagagagtgagcccctcgtcacaagaggcatgcaagcaggagtgggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagtgcccccagcagcagtagcagtgccaagggtggcggagccccatggcctgggggtgcccaaacatactcacccagttccacctgtcgctaccgcagcctggcgcagccagccaccaccaccgctcgcctctccagcgtttcctcccatgactctggcttcgtctcccaggacgccacctactccaagcccccctcgcctatgccttcagacatcaccagccagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgcggggctgcccacggccactggcctgccctcgggcgcaccccccggcgtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatga

SEQ ID NO: 9016 - DNA, 365 bp, Artificial Sequence; identical to SEQ ID NO: 7364
  Synthetic polypeptide

SEQ ID NO: 9017 - DNA, 664 bp, Artificial Sequence
  Synthetic polypeptide
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 9018 - DNA, 574 bp, Artificial Sequence
  Synthetic polypeptide
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagagccagccgccgccacctccctactacccaccggaagataa

SEQ ID NO: 9019 - DNA, 652 bp, Artificial Sequence
  Synthetic polypeptide
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 9020 - DNA, 529 bp, Artificial Sequence
  Synthetic polypeptide
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 9021 - DNA, 445 bp, Artificial Sequence
  Synthetic polypeptide
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggcc

SEQ ID NO: 9022 - DNA, 857 bp, Artificial Sequence
  Synthetic polypeptide
gtctgggcgcaaagcacaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtga

SEQ ID NO: 9023 - DNA, 854 bp, Artificial Sequence
  Synthetic polypeptide
gtctgggcgcaaagcacaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttag

SEQ ID NO: 9024 - DNA, 875 bp, Artificial Sequence
  Synthetic polypeptide
gtctgggcgcaaagcacaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctag

SEQ ID NO: 9025 - DNA, 302 bp, Artificial Sequence
  Synthetic polypeptide
gtctgggcgcaaagcacaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggagtaccaggacctgctcaatgtcaagctggccctggacatcgagatcgccacctacaggaagctgctagagggcgaggagaaccggatcaccattcccgtgcagaccttctccaacctgcagatt

SEQ ID NO: 9026 - DNA, 343 bp, Artificial Sequence
  Synthetic polypeptide
gtctgggcgcaaagcacaggctccaggatgaaaccaacctgaggctggaagccgagaacaacctggctgcctatagacaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctg

SEQ ID NO: 9027 - DNA, 105 bp, Artificial Sequence
  Synthetic polypeptide
gtctgggcgcaaagcacaggctccaggatgaaaccaacctgaggctggaagccgagaacaacctggctgcctatagacaggaagcagatgaagccaccctggccc

SEQ ID NO: 9028 - DNA, 1579 bp, Artificial Sequence
  Synthetic polypeptide
cagcagacccctgaataacatccttctgttataacgttgatgaggaaaaaaaattgtttccctgctgggatcaccgtctgtgtggcatttgcatgtcctccccatgtcttcctgggttttctccaggtaccccggtcagtttcctcccacatcccgaagatatgcatgttaggcaaactgctgtgtctatgtagtcccagtgtgaacgattgtgggtgtgggtgagtctgctctgcgatgtgatggcgtcctgtccagggctggttactgcctcgagccctgagctgccgggacaggctctggccactgaactctaaactggaataagcaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaa

SEQ ID NO: 9029 - DNA, 1600 bp, Artificial Sequence
  Synthetic polypeptide
cagcagacccctgaataacatccttctgttataacgttgatgaggaaaaaaaattgtttccctgctgggatcaccgtctgtgtggcatttgcatgtcctccccatgtcttcctgggttttctccaggtaccccggtcagtttcctcccacatcccgaagatatgcatgttaggcaaactgctgtgtctatgtagtcccagtgtgaacgattgtgggtgtgggtgagtctgctctgcgatgtgatggcgtcctgtccagggctggttactgcctcgagccctgagctgccgggacaggctctggccactgaactctaaactggaataagcaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcgcaacatactattcatgtagtggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaa

SEQ ID NO: 9030 - DNA, 457 bp, Artificial Sequence
  Synthetic polypeptide
cagcagacccctgaataacatccttctgttataacgttgatgaggaaaaaaaattgtttccctgctgggatcaccgtctgtgtggcatttgcatgtcctccccatgtcttcctgggttttctccaggtaccccggtcagtttcctcccacatcccgaagatatgcatgttaggcaaactgctgtgtctatgtagtcccagtgtgaacgattgtgggtgtgggtgagtctgctctgcgatgtgatggcgtcctgtccagggctggttactgcctcgagccctgagctgccgggacaggctctggccactgaactctaaactggaataagcaggtggactcccattattgtcccagttgtttagaaaatatgccatcggctgaagccaaactaaaaaagaatagactaggggaatgtattttgcggaggagaaccacagagatgtgccaattgttttga

SEQ ID NO: 9031 - DNA, 3055 bp, Artificial Sequence; identical to SEQ ID NO: 709
  Synthetic polypeptide

SEQ ID NO: 9032 - DNA, 3058 bp, Artificial Sequence; identical to SEQ ID NO: 710
  Synthetic polypeptide

SEQ ID NO: 9033 - DNA, 525 bp, Artificial Sequence
  Synthetic polypeptide
ggccaggtgcagtggttcatgcctgcaatcccagcacttttggaggccaagcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctga

SEQ ID NO: 9034 - DNA, 342 bp, Artificial Sequence
  Synthetic polypeptide
ggccaggtgcagtggttcatgcctgcaatcccagcacttttggaggccaagcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctga

SEQ ID NO: 9035 - DNA, 2287 bp, Artificial Sequence; identical to SEQ ID NO: 6799
  Synthetic polypeptide

SEQ ID NO: 9036 - DNA, 2234 bp, Artificial Sequence; identical to SEQ ID NO: 6800
  Synthetic polypeptide

SEQ ID NO: 9037 - DNA, 456 bp, Artificial Sequence
  Synthetic polypeptide
cagcctacatgcgcaacggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttga

SEQ ID NO: 9038 - DNA, 3519 bp, Artificial Sequence
  Synthetic polypeptide
gagcaacttccagtcctgcaagctccattcatggctcctgtgacgtttgatgacatcactgtgtacttactccaggaggaatgggtgctgctgagccagcaacagaaggagctctgtggttccaacaagctggtggcaccactgggaccaactgttgccaatcctgagctgttccgcaagttcggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttgggacctgccgctgccaagccagacttgatctccaaactggagcggagggctgcaccctggatcaaggacccaaatgggccaaagtgggggaaaggtcgtcctccagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctgcctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagcgccaggctcaggaaggaggagatgggagccctctatgtggaggagcccaggacccagaagccacccatcctgccctccagggaagcagcggaggttctgaaggactgcatcatggagcctcccgagagactcctgtatccccacaccagccaggaggcccccgggatgtcctga

SEQ ID NO: 9039 - DNA, 2086 bp, Artificial Sequence
  Synthetic polypeptide
aaagacagaacaaattcaaagtgagaaaatccagatctctttcctagttctgcccggcatttgctatatggccttgggcatgtcaattacccacctaggacttggtttctcctgtttaccatttgggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 9040 - DNA, 2065 bp, Artificial Sequence
  Synthetic polypeptide
aaagacagaacaaattcaaagtgagaaaatccagatctctttcctagttctgcccggcatttgctatatggccttgggcatgtcaattacccacctaggacttggtttctcctgtttaccatttgggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 9041 - DNA, 1875 bp, Artificial Sequence
  Synthetic polypeptide
tttcttcaacaaacgaatgacattgaaaagggaggaggggccagtgcagatgctgacagaggctgccgagatgatgaggcaggtgtgctgtggggcctggtatggctgttggttcaaaccttccaactacaaaaagacgtctatgagaccatcaaggcacattgaagagggcctgattattgactgataagcaagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttga

SEQ ID NO: 9042 - DNA, 23 bp, Artificial Sequence
  Synthetic polypeptide
tcaagctccctcctgctgagtga

SEQ ID NO: 9043 - DNA, 1088 bp, Artificial Sequence
  Synthetic polypeptide
ctgtgcttccaaatgctggtgctgtttgcacacttgtgtctttggccttcactggttctgcttagaatctcccttccatgggtatctacctgaccatctgctcctcttctttccagtcttccactcaacaggtacttcgttagagcaggcccccaggctgcccttacccatgccacaacagctacctacttccttgtgtcatcattgaagagcttgtctgtttgagttgtgatcgtgtttgtctgtctgccctcaccagcaaactgagctcccgtgaagtcagggccaggttcatctgtgcatcgtcagtggctgacaggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaa

SEQ ID NO: 9044 - DNA, 971 bp, Artificial Sequence
  Synthetic polypeptide
ctgtgcttccaaatgctggtgctgtttgcacacttgtgtctttggccttcactggttctgcttagaatctcccttccatgggtatctacctgaccatctgctcctcttctttccagtcttccactcaacaggtacttcgttagagcaggcccccaggctgcccttacccatgccacaacagctacctacttccttgtgtcatcattgaagagcttgtctgtttgagttgtgatcgtgtttgtctgtctgccctcaccagcaaactgagctcccgtgaagtcagggccaggttcatctgtgcatcgtcagtggctgacaggacatggacatcttccagcaacagatctcgagaagacagctggctaaaatccttatttgtccggaaagttgatccaagaaaagatgcccactccaatctcctagccaaaaaggaaacaagcaatctatacaaattacagttcaagaggtgttgccaaagattcacgaagataaacactacccttgtactttggtggggacttggaacacgtggtatggcgagcaggaccaagctggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaa

SEQ ID NO: 9045 - DNA, 665 bp, Artificial Sequence
  Synthetic polypeptide
ctgtgcttccaaatgctggtgctgtttgcacacttgtgtctttggccttcactggttctgcttagaatctcccttccatgggtatctacctgaccatctgctcctcttctttccagtcttccactcaacaggtacttcgttagagcaggcccccaggctgcccttacccatgccacaacagctacctacttccttgtgtcatcattgaagagcttgtctgtttgagttgtgatcgtgtttgtctgtctgccctcaccagcaaactgagctcccgtgaagtcagggccaggttcatctgtgcatcgtcagtggctgacaggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgcagctccctgtttgcagaacataaagacttaactcctgcctggtttttaggggtcccaataatgggattctgcccaacccatccagttctgggtacaagtactgcctgccttacaatctccattcagtcaagaggtgttgccaaagattcacgaagataa

SEQ ID NO: 9046 - DNA, 820 bp, Artificial Sequence
  Synthetic polypeptide
gaacagcatgcgtgttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatag

SEQ ID NO: 9047 - DNA, 62 bp, Artificial Sequence
  Synthetic polypeptide
gaacagcatgcgtgttgactggattgttgctgacatcttggccatcaggcagaatgcgctag

SEQ ID NO: 9048 - DNA, 514 bp, Artificial Sequence
  Synthetic polypeptide
gaccgggcacagtggctcgcgcctgtaatcccagcactttgggaggccaaggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctga

SEQ ID NO: 9049 - DNA, 475 bp, Artificial Sequence
  Synthetic polypeptide
gaccgggcacagtggctcgcgcctgtaatcccagcactttgggaggccaaggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtga

SEQ ID NO: 9050 - DNA, 553 bp, Artificial Sequence
  Synthetic polypeptide
gaccgggcacagtggctcgcgcctgtaatcccagcactttgggaggccaaggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgaggaagcagtggctcagagctccgtgacgttttttggaacgggaggtgcgagatgcagacatttaacacatccggggctgtag

SEQ ID NO: 9051 - DNA, 213 bp, Artificial Sequence
  Synthetic polypeptide
tgaagatttagtgaaacattgtggaaagctcccagcacagtacctggcacctggcagacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtga

SEQ ID NO: 9052 - DNA, 853 bp, Artificial Sequence
  Synthetic polypeptide
ttttacttaaaattttctttgttgttttttctcctacccattagaatgtaagttccataaagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtga

SEQ ID NO: 9053 - DNA, 265 bp, Artificial Sequence
  Synthetic polypeptide
ttttacttaaaattttctttgttgttttttctcctacccattagaatgtaagttccataaagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaaggtgtgcagctag

SEQ ID NO: 9054 - DNA, 393 bp, Artificial Sequence
  Synthetic polypeptide
ggccgggcgcggtggctcacgcctgtaatcccagcactttggaaggccgaggagggcagatcacgaggtgtggggttagccaccagaaaactgggaaatttggccaaacccactgtgatcatcagcaagaaaggagatattataactatacgaactgaaagtacctttaaaaatacagaaatctccttcaagctaggccaggaatttgaagaaaccacagctgacaatagaaagaccaagagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctga

SEQ ID NO: 9055 - DNA, 304 bp, Artificial Sequence
  Synthetic polypeptide
cttggggccacaagtttgagaccagcctgggcaacatagcaagatcttgtctctacaaaaaaaaatgtttaaagaatttttttaaattagcacccgtagctccagcttctcagaagattgagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaa

SEQ ID NO: 9056 - DNA, 89 bp, Artificial Sequence
  Synthetic polypeptide
aagccgaggcagggtgatcacgaggtcaggagttcaagaccagcctggcaaacatgacgtgcctgcttccccttcgccttctgccgtga

SEQ ID NO: 9057 - DNA, 267 bp, Artificial Sequence
  Synthetic polypeptide
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 9058 - DNA, 739 bp, Artificial Sequence
  Synthetic polypeptide
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 9059 - DNA, 460 bp, Artificial Sequence
  Synthetic polypeptide
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 9060 - DNA, 147 bp, Artificial Sequence
  Synthetic polypeptide
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaactatga

SEQ ID NO: 9061 - DNA, 147 bp, Artificial Sequence
  Synthetic polypeptide
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaactgtga

SEQ ID NO: 9062 - DNA, 113 bp, Artificial Sequence
  Synthetic polypeptide
ggttgggcgcagtggcccacgcctgtaaccccagcactttgggaggccaaggcaggaggatcatttgagcccaggagtttgagaccagcctggccaatatggacaagcactga

SEQ ID NO: 9063 - DNA, 985 bp, Artificial Sequence
  Synthetic polypeptide
tcctagggctgttctaaagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctga

SEQ ID NO: 9064 - DNA, 207 bp, Artificial Sequence
  Synthetic polypeptide
tcctagggctgttctaaagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcac

SEQ ID NO: 9065 - DNA, 1672 bp, Artificial Sequence
  Synthetic polypeptide
tcctccaccagatgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatga

SEQ ID NO: 9066 - DNA, 2346 bp, Artificial Sequence
  Synthetic polypeptide
ttcacatgattgactcctactcattaagactcacccaaggaaatccacattcaggaagccttttctgccccttcaccgctctggtatcccctccaccagtcttgagtggatgctcctcctgtgtctctcagtgcccagtgcatacttctatcatggaacattgttctggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatatag

SEQ ID NO: 9067 - DNA, 379 bp, Artificial Sequence
  Synthetic polypeptide
tgggactcatcatgtacccattattagaccaggcaagaattattaatggatgctaaatatggggattgtttcactaaggagaagaatatttgcgtggttttcttattacagacttactttcaaagggggctggggggaggagtaattatatattggagaaaggggacaatgccttgaccagataatcaaaatcaacatcaccaatgagggacagataggcttatattatctctctaggtggatactctaaaggcacgacatctctgcagcattccagccaaaaatacatgatgcatacccagagtatcttatcacttaccagatcatgaagccagaagccccttcccagaccgcaacagccgcagagcagaagacctag

SEQ ID NO: 9068 - DNA, 740 bp, Artificial Sequence
  Synthetic polypeptide
ggccggacgtggttactcacgcctgtaatcccagcactttgggaggccaaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataa

SEQ ID NO: 9069 - DNA, 1607 bp, Artificial Sequence
  Synthetic polypeptide
ggctaggtgtggtggctcacacctatcccagcactttgggaggcagaggtgggaggatcgcttaaacccaggagttcaagaccagcctggatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctga

SEQ ID NO: 9070 - DNA, 809 bp, Artificial Sequence
  Synthetic polypeptide
ggctaggtgtggtggctcacacctatcccagcactttgggaggcagaggtgggaggatcgcttaaacccaggagttcaagaccagcctggatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgaggtatgtctaggagacccttgggccctccccgcagtgggggcccctccaagaaatccagaggacagaatcagagctcaaagctgcatcccttctggcctcgtgacttcaagtctctctgggctaccagcaggtgggccactcgctggggctcaatgtagtcccagcctttttaggtccttgtggaagtcacttgtgcctggcacacagaaggcaagtaagagacttgatttcagttttaggcagagtgaccagggcagcgatgggagacgcccaggctgcagagtggggaagaagggctga

SEQ ID NO: 9071 - DNA, 543 bp, Artificial Sequence
  Synthetic polypeptide
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaa

SEQ ID NO: 9072 - DNA, 1095 bp, Artificial Sequence
  Synthetic polypeptide
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatga

SEQ ID NO: 9073 - DNA, 267 bp, Artificial Sequence
  Synthetic polypeptide
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaattttcataa

SEQ ID NO: 9074 - DNA, 450 bp, Artificial Sequence
  Synthetic polypeptide
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatg

SEQ ID NO: 9075 - DNA, 824 bp, Artificial Sequence
  Synthetic polypeptide
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtga

SEQ ID NO: 9076 - DNA, 285 bp, Artificial Sequence
  Synthetic polypeptide
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagttataggatattccaagataaatgcatga

SEQ ID NO: 9077 - DNA, 454 bp, Artificial Sequence
  Synthetic polypeptide
gactgggcgcagtggctcacgcctgtaatcccagcactttgggaggccgaggcgggcggatcacgagtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttga

SEQ ID NO: 9078 - DNA, 682 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctga

SEQ ID NO: 9079 - DNA, 78 bp, Artificial Sequence
  Synthetic polypeptide
tggagagggcaggagctccgatgtcagccagactggctccaaaaccaacgccctcaatgtctcccagaagatgattga

SEQ ID NO: 9080 - DNA, 481 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaagtag

SEQ ID NO: 9081 - DNA, 292 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagag

SEQ ID NO: 9082 - DNA, 236 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttca

SEQ ID NO: 9083 - DNA, 682 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaacatcagtggggcctcacctgcccgccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctga

SEQ ID NO: 9084 - DNA, 347 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaccttctccttagcacccccaccagatctggaaggacttttcagcctcatccagcagaaaactgagcttccggtcacagagaacgtgcagacgattcccccgccatatgtgg

SEQ ID NO: 9085 - DNA, 273 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcacacccccaccagatctggaaggacttttcagcctcat

SEQ ID NO: 9086 - DNA, 317 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccat

SEQ ID NO: 9087 - DNA, 369 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagtt

SEQ ID NO: 9088 - DNA, 175 bp, Artificial Sequence
  Synthetic polypeptide
tggagagggcaggagctccgatgtcagccagactggctccaaaaccaacgccctcaatgtctcccagaagatgattgagatgttcgtgcggacaaaacacaagatcgacaaaagccactgtctgaaccatccctgtacatctgcaccttcttgtgcaaggaagtccttggcctaa

SEQ ID NO: 9089 - DNA, 650 bp, Artificial Sequence
  Synthetic polypeptide
ggtgagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatga

SEQ ID NO: 9090 - DNA, 1052 bp, Artificial Sequence
  Synthetic polypeptide
ggtgagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctga

SEQ ID NO: 9091 - DNA, 959 bp, Artificial Sequence; identical to SEQ ID NO: 7258
  Synthetic polypeptide

SEQ ID NO: 9092 - DNA, 649 bp, Artificial Sequence; identical to SEQ ID NO: 7259
  Synthetic polypeptide

SEQ ID NO: 9093 - DNA, 1521 bp, Artificial Sequence
  Synthetic polypeptide
atgggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaa

SEQ ID NO: 9094 - DNA, 792 bp, Artificial Sequence
  Synthetic polypeptide
tgtggtggttctaaaatttgtccagagattctttgatgctgcttccattaagtggtggagcttaatttccctctcctggagtgtggggtggacgcagtggctcactgctaatgaacagaataaagcacaagtgttagtgtgtgattgcagaaactaggtcgtaaaaatcactgcagcttcctcctttcttcctaactgtgcactctgggtaaagccagctgccatgtcataaggagatcaagcagctccacagaaaagtcagcatggcaaggagctaaggctttctgccgatagcctctgagggactgaggcctccagccaacagccacgcaaatgagccatcatggaatcagatcagcccaagttaaaccttcagcttcttggtgatggcttacctgaatcatcatgacagactcagtcagagtcacctggccctgaatccttgacccacagaaactgtgagctaataaatgtgtgttgttttgagctgctaaacaaaaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataa

SEQ ID NO: 9095 - DNA, 699 bp, Artificial Sequence
  Synthetic polypeptide
tgtggtggttctaaaatttgtccagagattctttgatgctgcttccattaagtggtggagcttaatttccctctcctggagtgtggggtggacgcagtggctcactgctaatgaacagaataaagcacaagtgttagtgtgtgattgcagaaactaggtcgtaaaaatcactgcagcttcctcctttcttcctaactgtgcactctgggtaaagccagctgccatgtcataaggagatcaagcagctccacagaaaagtcagcatggcaaggagctaaggctttctgccgatagcctctgagggactgaggcctccagccaacagccacgcaaatgagccatcatggaatcagatcagcccaagttaaaccttcagcttcttggtgatggcttacctgaatcatcatgacagactcagtcagagtcacctggccctgaatccttgacccacagaaactgtgagctaataaatgtgtgttgttttgagctgctaaacaaaaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacagtgagtacagagtag

SEQ ID NO: 9096 - DNA, 89 bp, Artificial Sequence; identical to SEQ ID NO: 9056
  Synthetic polypeptide

SEQ ID NO: 9097 - DNA, 267 bp, Artificial Sequence; identical to SEQ ID NO: 9057
  Synthetic polypeptide

SEQ ID NO: 9098 - DNA, 423 bp, Artificial Sequence; identical to SEQ ID NO: 6550
  Synthetic polypeptide

SEQ ID NO: 9099 - DNA, 340 bp, Artificial Sequence; identical to SEQ ID NO: 8550
  Synthetic polypeptide

SEQ ID NO: 9100 - DNA, 1143 bp, Artificial Sequence
  Synthetic polypeptide
cttggcaggtggtgagctccccactgcaggctgtattcaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaa

SEQ ID NO: 9101 - DNA, 355 bp, Artificial Sequence
  Synthetic polypeptide
cttggcaggtggtgagctccccactgcaggctgtattcaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatg

SEQ ID NO: 9102 - DNA, 156 bp, Artificial Sequence; identical to SEQ ID NO: 6906
  Synthetic polypeptide

SEQ ID NO: 9103 - DNA, 662 bp, Artificial Sequence
  Synthetic polypeptide
gatttaaatgagattgccagcctagagagggtctctattggcatgccgtagagctctgccattggctattttttgtagaacttattaatgacttggatgaagaaaaggaagacctgtgtgttaagttagtggatggcttaaagctgtgtgctgtcaccattcatgagacgatgcaattgagattccaaaagattttgcaattttgctggtctggaagatgtccaaataaggaatgaaattcagtggagatggatgtaaaatcctacccttaagccccatagcatccatcatcatccaaggacggacggagaagcagcacatgcagataaagcttgcatttctctgcaggctcagagagaatcctcagcggcttgggcccagcacaggagaggtcactgccacacatttgcccttggcatggtctccagaaccatgcattgcatcctgggagcaacattttctgagatattctggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatga

SEQ ID NO: 9104 - DNA, 1771 bp, Artificial Sequence
  Synthetic polypeptide
cgtgagccagagacggggcacaggctgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 9105 - DNA, 56 bp, Artificial Sequence
  Synthetic polypeptide
cgtgagccagagacggggcacaggctgccttcgggagctcccagacccagtgctga

SEQ ID NO: 9106 - DNA, 1810 bp, Artificial Sequence
  Synthetic polypeptide
cgtgagccagagacggggcacaggctgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 9107 - DNA, 1768 bp, Artificial Sequence
  Synthetic polypeptide
cgtgagccagagacggggcacaggctgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 9108 - DNA, 677 bp, Artificial Sequence
  Synthetic polypeptide
cgtgagccagagacggggcacaggctgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggcca

SEQ ID NO: 9109 - DNA, 872 bp, Artificial Sequence
  Synthetic polypeptide
aggggctgtcataggagctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttgctgagagctacaaaaagaagataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcaaaaagctaacatga

SEQ ID NO: 9110 - DNA, 242 bp, Artificial Sequence
  Synthetic polypeptide
aggggctgtcataggagctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcaggacacaagaggaaaaactggaaggtgcgtcgctttgttctaa

SEQ ID NO: 9111 - DNA, 620 bp, Artificial Sequence
  Synthetic polypeptide
aggggctgtcataggagctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctg

SEQ ID NO: 9112 - DNA, 803 bp, Artificial Sequence
  Synthetic polypeptide
cagggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatga

SEQ ID NO: 9113 - DNA, 347 bp, Artificial Sequence
  Synthetic polypeptide
cagggccaagattaacacccctcctgcaggaggaagacagccaccagcggctgctcatggggctgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatg

SEQ ID NO: 9114 - DNA, 470 bp, Artificial Sequence
  Synthetic polypeptide
ggttgctgtgagaattaaatgagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaa

SEQ ID NO: 9115 - DNA, 134 bp, Artificial Sequence
  Synthetic polypeptide
ggttgctgtgagaattaaatgagaaaagaaaactccttccagacactattttggagaagttaaccacagcttcacagactaacatcaagaaatcgccaggaaaggtgaaagaaggtatgactattctaatttaa

SEQ ID NO: 9116 - DNA, 154 bp, Artificial Sequence
  Synthetic polypeptide
tggtggtgctgattactatgattacggacatggactcagtgaggagacttatgattcctacgggcaagaagagtggactaactcaagacacaaggcaccttcagcgaggacagcaaagggcgtctacagagaccagccatatggcagatactga

SEQ ID NO: 9117 - DNA, 12 bp, Artificial Sequence
  Synthetic polypeptide
tggtggtgctga

SEQ ID NO: 9118 - DNA, 786 bp, Artificial Sequence
  Synthetic polypeptide
cggtgcttcttacctgaggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 9119 - DNA, 969 bp, Artificial Sequence
  Synthetic polypeptide
cggtgcttcttacctgaggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 9120 - DNA, 91 bp, Artificial Sequence
  Synthetic polypeptide
cggtgcttcttacctgaggaatccggacaatcagatagttcaaaccagcaaggagatgcggacatcaaaccactgcccaacgggcacttaa

SEQ ID NO: 9121 - DNA, 663 bp, Artificial Sequence
  Synthetic polypeptide
cggtgcttcttacctgaggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 9122 - DNA, 846 bp, Artificial Sequence
  Synthetic polypeptide
cggtgcttcttacctgaggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 9123 - DNA, 839 bp, Artificial Sequence
  Synthetic polypeptide
gaaagacgtctgggttctggtcctgactctgttacccttggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtga

SEQ ID NO: 9124 - DNA, 1464 bp, Artificial Sequence
  Synthetic polypeptide
cacagaaggaccaccaagtgaagaggcagcaaatgggcagccctctgccagccgaggagacaggcctcagaggaaacccaaccctgctgacatcttgatcgtggacttccagtctctagaacggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctga

SEQ ID NO: 9125 - DNA, 477 bp, Artificial Sequence; identical to SEQ ID NO: 8538
  Synthetic polypeptide

SEQ ID NO: 9126 - DNA, 357 bp, Artificial Sequence
  Synthetic polypeptide
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggtagattcttcaagtttacactcctag

SEQ ID NO: 9127 - DNA, 1218 bp, Artificial Sequence
  Synthetic polypeptide
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctag

SEQ ID NO: 9128 - DNA, 435 bp, Artificial Sequence
  Synthetic polypeptide
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggctggtcttga

SEQ ID NO: 9129 - DNA, 552 bp, Artificial Sequence
  Synthetic polypeptide
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatag

SEQ ID NO: 9130 - DNA, 543 bp, Artificial Sequence
  Synthetic polypeptide
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtagattcttcaagtttacactcctagcatcattgtttcttctctctctcaaccttcacctatggctggtcttgaatttctgggttcaagtgaccctcctgcctcagcctcctgagtag

SEQ ID NO: 9131 - DNA, 786 bp, Artificial Sequence
  Synthetic polypeptide
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccagagctgggagtacccaagcctgcagttttga

SEQ ID NO: 9132 - DNA, 177 bp, Artificial Sequence
  Synthetic polypeptide
cagtggttagcaagctgtggtcctatggaccatatcctctgctgcttgttttatgtacctgtgtggtctaagctggaatctggtcaccttccatccatgcaacaacttgttcaaattcttgacaatgaaatgaagctcaatgtgcatatggattcaatcccacaccatcgatcatag

SEQ ID NO: 9133 - DNA, 482 bp, Artificial Sequence
  Synthetic polypeptide
tcattgtatatgctcatgacaacctgggtttttcttcatgacaactgtcattgcatatagttttgtgccagaataatatccataatcaggcccatatgaacagagtggtcacacacgagcttattcatgcatttgatcattgtcgtgcccatgtcgactggttcaccaacatcagacatttggcgtgctcagaggttcgagctgctaaccttagtggagactgctcacttgtcaatgaaatattcaggttacattttggattaaaacaacaccaccagacttgtgtgcgagacagagccactctttctatcctggctgttaggaatatcagcaaagaagtagctaaaaaggctgttgatgaagtttttgaatcttgtttcaatgaccatgaaccttttggaaggatcccacataacaagacttatgcaagatatgctcacagagactttgaaaaccgtgatcggtattattcaaatatatga

SEQ ID NO: 9134 - DNA, 76 bp, Artificial Sequence
  Synthetic polypeptide
tcattgtatatgctcatgacaacctgggtttttcttcatgacaactgtcattgcatatagttttgtgccagaataa

SEQ ID NO: 9135 - DNA, 861 bp, Artificial Sequence; identical to SEQ ID NO: 604
  Synthetic polypeptide

SEQ ID NO: 9136 - DNA, 1282 bp, Artificial Sequence
  Synthetic polypeptide
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 9137 - DNA, 177 bp, Artificial Sequence
  Synthetic polypeptide
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtga

SEQ ID NO: 9138 - DNA, 577 bp, Artificial Sequence
  Synthetic polypeptide
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaa

SEQ ID NO: 9139 - DNA, 574 bp, Artificial Sequence
  Synthetic polypeptide
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtatatcaagttactgtgtatcaggcaggggagagtgatacagattcatttgaagaagatcctgaaatttccttagctgactattgg

SEQ ID NO: 9140 - DNA, 400 bp, Artificial Sequence
  Synthetic polypeptide
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggct

SEQ ID NO: 9141 - DNA, 173 bp, Artificial Sequence
  Synthetic polypeptide
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtga

SEQ ID NO: 9142 - DNA, 319 bp, Artificial Sequence
  Synthetic polypeptide
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacaggatcttga

SEQ ID NO: 9143 - DNA, 805 bp, Artificial Sequence
  Synthetic polypeptide
cgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactga

SEQ ID NO: 9144 - DNA, 578 bp, Artificial Sequence
  Synthetic polypeptide
cgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggaggaaacagttgcagagctaagaactgttgagagtgaagctgcatcttatctggaccagatttctagatattatattacaagagccaaattggtttctaaaatagctaaatatccccatgtggaggactatc

SEQ ID NO: 9145 - DNA, 433 bp, Artificial Sequence
  Synthetic polypeptide
cgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggtcaaaatgtgggtacagctcctgattcccaggatagaagatggaaacaactttggggtgtccattcaggaggaaacagttgcagagctaagaactgttga

SEQ ID NO: 9146 - DNA, 844 bp, Artificial Sequence
  Synthetic polypeptide
cgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacgccttcaggcaaaggtcctcatatatgttttgacctccaggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactga

SEQ ID NO: 9147 - DNA, 637 bp, Artificial Sequence
  Synthetic polypeptide
cgggagggcgagcgagagagcaagcaggcagcaggctgccggcgggcgggcggacggcacagagggagggagcgagcgagcagttgattctttcagggagcggatcacaagtgagcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactga

SEQ ID NO: 9148 - DNA, 1166 bp, Artificial Sequence
  Synthetic polypeptide
attaaaggcaaagaaaggctgtggaaacattccaaatgaaaggaggctattaagtaacagctttatgcaatttctagtcctacactgtatcctgtgctgcagggacaaaaatgctgtacggaacaagagatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtga

SEQ ID NO: 9149 - DNA, 1061 bp, Artificial Sequence
  Synthetic polypeptide
attaaaggcaaagaaaggctgtggaaacattccaaatgaaaggaggctattaagtaacagctttatgcaatttctagtcctacactgtatcctgtgctgcagggacaaaaatgctgtacggaacaagagatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagctctcatcggtgtctgtgttttcatcttggcaataattggcattttacattggcaggaaaagaaagcagatga

SEQ ID NO: 9150 - DNA, 621 bp, Artificial Sequence
  Synthetic polypeptide
aatcctttagtcccatcagatttacttttagacatatcccagatccagataatttgcaccatcttcactgcaactctcttccaggtcctggaaggtaacagtcttcttgttgatcctccagcctatgttcttgtgcctggaatctactctctgtgtggaagaactccgcaaaacagattttgtcatgcccccgttgtcaaccttccattggcttccaaccactacacaatgacacccaaactccttgtttgagtctggaatgccccgaatgatctgccttcctcatcttttccatgcctctctttattcacccaatagcagttacattgccctttttctattcttggacacgttaagcttgtttctgccttaggctgtctgtactggccacttcctctgcgtggaatggttcttcctggatctcacatggcttgctgtttctgcttattcatgactcagctcagattccccaccaaaccccagccaggctttccctgtcctctctgcaagtggcccttactccagctccagaaacatgacaaggaggactttcctgcctcttggagatcagaggaggaaatggcagcagaagccgcagctctgcgggtctactttcagtga

SEQ ID NO: 9151 - DNA, 152 bp, Artificial Sequence
  Synthetic polypeptide
ttgctgggagtggtggcgtgcccctgtaatcccagctactctggaggctgaggtgggaggatccattgagccttggaggttgtgccacagctctagcctggaccacagagaagccactgaggaacggcctggtgaaggacaagcgcttctga

SEQ ID NO: 9152 - DNA, 1732 bp, Artificial Sequence
  Synthetic polypeptide
cagtagttcctccttatccacagttttttgcctccacagttttggttacctgcagcaaactgtggtttgaaaatagacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatgttggaccctttttgtga

SEQ ID NO: 9153 - DNA, 1125 bp, Artificial Sequence
  Synthetic polypeptide
cctgcttccagcacttctggctaagttgcgccgtgggaaaattgttttgtctgattcagttttctcatcttttaaactggaataatgctacctaatttacagggttgtttgaagaattaaatgaatgcatggagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 9154 - DNA, 720 bp, Artificial Sequence
  Synthetic polypeptide
cctgcttccagcacttctggctaagttgcgccgtgggaaaattgttttgtctgattcagttttctcatcttttaaactggaataatgctacctaatttacagggttgtttgaagaattaaatgaatgcatggagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtatatctatgttgctga

SEQ ID NO: 9155 - DNA, 1089 bp, Artificial Sequence
  Synthetic polypeptide
cctgcttccagcacttctggctaagttgcgccgtgggaaaattgttttgtctgattcagttttctcatcttttaaactggaataatgctacctaatttacagggttgtttgaagaattaaatgaatgcatggagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 9156 - DNA, 213 bp, Artificial Sequence
  Synthetic polypeptide
cctgcttccagcacttctggctaagttgcgccgtgggaaaattgttttgtctgattcagttttctcatcttttaaactggaataatgctacctaatttacagggttgtttgaagaattaaatgaatgcatggagaaatcgacttaaagcctccagagaagtagaatctgtagaccttccacactgccacctgattaaaggaattgtgtggtga

SEQ ID NO: 9157 - DNA, 1737 bp, Artificial Sequence; identical to SEQ ID NO: 905
  Synthetic polypeptide

SEQ ID NO: 9158 - DNA, 284 bp, Artificial Sequence; identical to SEQ ID NO: 906
  Synthetic polypeptide

SEQ ID NO: 9159 - DNA, 856 bp, Artificial Sequence; identical to SEQ ID NO: 907
  Synthetic polypeptide

SEQ ID NO: 9160 - DNA, 802 bp, Artificial Sequence; identical to SEQ ID NO: 908
  Synthetic polypeptide

SEQ ID NO: 9161 - DNA, 561 bp, Artificial Sequence; identical to SEQ ID NO: 909
  Synthetic polypeptide

SEQ ID NO: 9162 - DNA, 582 bp, Artificial Sequence; identical to SEQ ID NO: 910
  Synthetic polypeptide

SEQ ID NO: 9163 - DNA, 304 bp, Artificial Sequence; identical to SEQ ID NO: 7490
  Synthetic polypeptide

SEQ ID NO: 9164 - DNA, 1148 bp, Artificial Sequence; identical to SEQ ID NO: 436
  Synthetic polypeptide

SEQ ID NO: 9165 - DNA, 163 bp, Artificial Sequence; identical to SEQ ID NO: 480
  Synthetic polypeptide

SEQ ID NO: 9166 - DNA, 104 bp, Artificial Sequence; identical to SEQ ID NO: 481
  Synthetic polypeptide

SEQ ID NO: 9167 - DNA, 1854 bp, Artificial Sequence; identical to SEQ ID NO: 6613
  Synthetic polypeptide

SEQ ID NO: 9168 - DNA, 2588 bp, Artificial Sequence; identical to SEQ ID NO: 6741
  Synthetic polypeptide

SEQ ID NO: 9169 - DNA, 1964 bp, Artificial Sequence; identical to SEQ ID NO: 6742
  Synthetic polypeptide

SEQ ID NO: 9170 - DNA, 382 bp, Artificial Sequence; identical to SEQ ID NO: 434
  Synthetic polypeptide

SEQ ID NO: 9171 - DNA, 851 bp, Artificial Sequence; identical to SEQ ID NO: 8176
  Synthetic polypeptide

SEQ ID NO: 9172 - DNA, 1385 bp, Artificial Sequence; identical to SEQ ID NO: 8177
  Synthetic polypeptide

SEQ ID NO: 9173 - DNA, 2738 bp, Artificial Sequence; identical to SEQ ID NO: 8152
  Synthetic polypeptide

SEQ ID NO: 9174 - DNA, 1331 bp, Artificial Sequence; identical to SEQ ID NO: 550
  Synthetic polypeptide

SEQ ID NO: 9175 - DNA, 1028 bp, Artificial Sequence; identical to SEQ ID NO: 551
  Synthetic polypeptide

SEQ ID NO: 9176 - DNA, 1295 bp, Artificial Sequence; identical to SEQ ID NO: 553
  Synthetic polypeptide

SEQ ID NO: 9177 - DNA, 1322 bp, Artificial Sequence; identical to SEQ ID NO: 554
  Synthetic polypeptide

SEQ ID NO: 9178 - DNA, 1013 bp, Artificial Sequence; identical to SEQ ID NO: 555
  Synthetic polypeptide

SEQ ID NO: 9179 - DNA, 520 bp, Artificial Sequence; identical to SEQ ID NO: 6424
  Synthetic polypeptide

SEQ ID NO: 9180 - DNA, 2537 bp, Artificial Sequence; identical to SEQ ID NO: 7357
  Synthetic polypeptide

SEQ ID NO: 9181 - DNA, 1913 bp, Artificial Sequence; identical to SEQ ID NO: 7358
  Synthetic polypeptide

SEQ ID NO: 9182 - DNA, 3021 bp, Artificial Sequence; identical to SEQ ID NO: 449
  Synthetic polypeptide

SEQ ID NO: 9183 - DNA, 3075 bp, Artificial Sequence; identical to SEQ ID NO: 450
  Synthetic polypeptide

SEQ ID NO: 9184 - DNA, 1143 bp, Artificial Sequence; identical to SEQ ID NO: 451
  Synthetic polypeptide

SEQ ID NO: 9185 - DNA, 1629 bp, Artificial Sequence; identical to SEQ ID NO: 8070
  Synthetic polypeptide

SEQ ID NO: 9186 - DNA, 1500 bp, Artificial Sequence; identical to SEQ ID NO: 8071
  Synthetic polypeptide

SEQ ID NO: 9187 - DNA, 2448 bp, Artificial Sequence; identical to SEQ ID NO: 6618
  Synthetic polypeptide

SEQ ID NO: 9188 - DNA, 1543 bp, Artificial Sequence; identical to SEQ ID NO: 6619
  Synthetic polypeptide

SEQ ID NO: 9189 - DNA, 1468 bp, Artificial Sequence; identical to SEQ ID NO: 6620
  Synthetic polypeptide

SEQ ID NO: 9190 - DNA, 2672 bp, Artificial Sequence; identical to SEQ ID NO: 6621
  Synthetic polypeptide

SEQ ID NO: 9191 - DNA, 1767 bp, Artificial Sequence; identical to SEQ ID NO: 6622
  Synthetic polypeptide

SEQ ID NO: 9192 - DNA, 1692 bp, Artificial Sequence; identical to SEQ ID NO: 6623
  Synthetic polypeptide

SEQ ID NO: 9193 - DNA, 1931 bp, Artificial Sequence; identical to SEQ ID NO: 7491
  Synthetic polypeptide

SEQ ID NO: 9194 - DNA, 161 bp, Artificial Sequence; identical to SEQ ID NO: 7668
  Synthetic polypeptide

SEQ ID NO: 9195 - DNA, 178 bp, Artificial Sequence; identical to SEQ ID NO: 7669
  Synthetic polypeptide

SEQ ID NO: 9196 - DNA, 486 bp, Artificial Sequence; identical to SEQ ID NO: 7296
  Synthetic polypeptide

SEQ ID NO: 9197 - DNA, 742 bp, Artificial Sequence; identical to SEQ ID NO: 6357
  Synthetic polypeptide

SEQ ID NO: 9198 - DNA, 590 bp, Artificial Sequence; identical to SEQ ID NO: 6358
  Synthetic polypeptide

SEQ ID NO: 9199 - DNA, 577 bp, Artificial Sequence; identical to SEQ ID NO: 6359
  Synthetic polypeptide

SEQ ID NO: 9200 - DNA, 430 bp, Artificial Sequence; identical to SEQ ID NO: 6360
  Synthetic polypeptide

SEQ ID NO: 9201 - DNA, 670 bp, Artificial Sequence; identical to SEQ ID NO: 6361
  Synthetic polypeptide

SEQ ID NO: 9202 - DNA, 1452 bp, Artificial Sequence; identical to SEQ ID NO: 7300
  Synthetic polypeptide

SEQ ID NO: 9203 - DNA, 1149 bp, Artificial Sequence; identical to SEQ ID NO: 7301
  Synthetic polypeptide

SEQ ID NO: 9204 - DNA, 1416 bp, Artificial Sequence; identical to SEQ ID NO: 7302
  Synthetic polypeptide

SEQ ID NO: 9205 - DNA, 1443 bp, Artificial Sequence; identical to SEQ ID NO: 7303
  Synthetic polypeptide

SEQ ID NO: 9206 - DNA, 1134 bp, Artificial Sequence; identical to SEQ ID NO: 7304
  Synthetic polypeptide

SEQ ID NO: 9207 - DNA, 427 bp, Artificial Sequence; identical to SEQ ID NO: 573
  Synthetic polypeptide

SEQ ID NO: 9208 - DNA, 1503 bp, Artificial Sequence; identical to SEQ ID NO: 8103
  Synthetic polypeptide

SEQ ID NO: 9209 - DNA, 645 bp, Artificial Sequence; identical to SEQ ID NO: 8104
  Synthetic polypeptide

SEQ ID NO: 9210 - DNA, 343 bp, Artificial Sequence; identical to SEQ ID NO: 8105
  Synthetic polypeptide

SEQ ID NO: 9211 - DNA, 2120 bp, Artificial Sequence; identical to SEQ ID NO: 6752
  Synthetic polypeptide

SEQ ID NO: 9212 - DNA, 1083 bp, Artificial Sequence
  Synthetic polypeptide
tggaagccccagagagattcgccaccgggtgaagacctgactcattccgggcttccccagacagacagctggcttacagggccacctgaagacgttccagggctccacaggccactgtcttctggaggggaacggatcgactgccggtgcgcccagccaaattcaactcctgagtcctcagtctctagtcccgggaagtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattga

SEQ ID NO: 9213 - DNA, 632 bp, Artificial Sequence; identical to SEQ ID NO: 8284
  Synthetic polypeptide

SEQ ID NO: 9214 - DNA, 416 bp, Artificial Sequence; identical to SEQ ID NO: 8285
  Synthetic polypeptide

SEQ ID NO: 9215 - DNA, 962 bp, Artificial Sequence; identical to SEQ ID NO: 8286
  Synthetic polypeptide

SEQ ID NO: 9216 - DNA, 863 bp, Artificial Sequence; identical to SEQ ID NO: 8287
  Synthetic polypeptide

SEQ ID NO: 9217 - DNA, 596 bp, Artificial Sequence; identical to SEQ ID NO: 8288
  Synthetic polypeptide

SEQ ID NO: 9218 - DNA, 962 bp, Artificial Sequence
  Synthetic polypeptide
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagtggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacatag

SEQ ID NO: 9219 - DNA, 959 bp, Artificial Sequence
  Synthetic polypeptide
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagtggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacatag

SEQ ID NO: 9220 - DNA, 543 bp, Artificial Sequence; identical to SEQ ID NO: 6496
  Synthetic polypeptide

SEQ ID NO: 9221 - DNA, 378 bp, Artificial Sequence; identical to SEQ ID NO: 6497
  Synthetic polypeptide

SEQ ID NO: 9222 - DNA, 267 bp, Artificial Sequence; identical to SEQ ID NO: 6498
  Synthetic polypeptide

SEQ ID NO: 9223 - DNA, 416 bp, Artificial Sequence; identical to SEQ ID NO: 6499
  Synthetic polypeptide

SEQ ID NO: 9224 - DNA, 162 bp, Artificial Sequence; identical to SEQ ID NO: 6500
  Synthetic polypeptide

SEQ ID NO: 9225 - DNA, 80 bp, Artificial Sequence; identical to SEQ ID NO: 6364
  Synthetic polypeptide

SEQ ID NO: 9226 - DNA, 217 bp, Artificial Sequence; identical to SEQ ID NO: 6365
  Synthetic polypeptide

SEQ ID NO: 9227 - DNA, 1216 bp, Artificial Sequence; identical to SEQ ID NO: 6819
  Synthetic polypeptide

SEQ ID NO: 9228 - DNA, 510 bp, Artificial Sequence; identical to SEQ ID NO: 6820
  Synthetic polypeptide

SEQ ID NO: 9229 - DNA, 1029 bp, Artificial Sequence; identical to SEQ ID NO: 8732
  Synthetic polypeptide

SEQ ID NO: 9230 - DNA, 1170 bp, Artificial Sequence; identical to SEQ ID NO: 8733
  Synthetic polypeptide

SEQ ID NO: 9231 - DNA, 1062 bp, Artificial Sequence; identical to SEQ ID NO: 8734
  Synthetic polypeptide

SEQ ID NO: 9232 - DNA, 573 bp, Artificial Sequence; identical to SEQ ID NO: 8735
  Synthetic polypeptide

SEQ ID NO: 9233 - DNA, 299 bp, Artificial Sequence; identical to SEQ ID NO: 8736
  Synthetic polypeptide

SEQ ID NO: 9234 - DNA, 337 bp, Artificial Sequence; identical to SEQ ID NO: 6393
  Synthetic polypeptide

SEQ ID NO: 9235 - DNA, 603 bp, Artificial Sequence; identical to SEQ ID NO: 8872
  Synthetic polypeptide

SEQ ID NO: 9236 - DNA, 369 bp, Artificial Sequence; identical to SEQ ID NO: 7297
  Synthetic polypeptide

SEQ ID NO: 9237 - DNA, 1582 bp, Artificial Sequence; identical to SEQ ID NO: 7488
  Synthetic polypeptide

SEQ ID NO: 9238 - DNA, 1376 bp, Artificial Sequence
  Synthetic polypeptide
agtggtttaaagtgtggattcgggcgtcagacccatgttgaaatccctagctcagccacgtgactagcttagtcctcaggcaagttctttaacatatttgtgccttagtctcctcatttctaaagtgaggataacaggacctgcctcaggacaatgcttggcatatagcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatga

SEQ ID NO: 9239 - DNA, 2411 bp, Artificial Sequence
  Synthetic polypeptide
agtggtttaaagtgtggattcgggcgtcagacccatgttgaaatccctagctcagccacgtgactagcttagtcctcaggcaagttctttaacatatttgtgccttagtctcctcatttctaaagtgaggataacaggacctgcctcaggacaatgcttggcatatagcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccattcgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttga

SEQ ID NO: 9240 - DNA, 423 bp, Artificial Sequence
  Synthetic polypeptide
agtggtttaaagtgtggattcgggcgtcagacccatgttgaaatccctagctcagccacgtgactagcttagtcctcaggcaagttctttaacatatttgtgccttagtctcctcatttctaaagtgaggataacaggacctgcctcaggacaatgcttggcatatagcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacg

SEQ ID NO: 9241 - DNA, 252 bp, Artificial Sequence; identical to SEQ ID NO: 7309
  Synthetic polypeptide

SEQ ID NO: 9242 - DNA, 853 bp, Artificial Sequence; identical to SEQ ID NO: 8074
  Synthetic polypeptide

SEQ ID NO: 9243 - DNA, 2698 bp, Artificial Sequence
  Synthetic polypeptide
tttccacggtctccctctcatgccgagccgaagctggacggtactgctgccatctcggctcactgcaacctccctgcctgattctcctgcctcagcttgccgagtgcctgcgattgcaggtgcacgccgccacgcctgactggttttcgtattttcttggtggagactgggattcgctgtgttggccgggctggtctccagctcctaaccgcgagtgatccgacagcctcggcctcccgaggtgccgggattgcagacggagtctcgttcattcagtgctcaatggtgcccaggctggagtgcagtggcgtgatcttggctcgtgcaacctccacctcccagcagcctgccttggcctcccaaagtgccgagattgcagcctctgcccggccgccaccccgtctgggaagtgaggagcttctccgcctggccgcctatcgtctgggatgtgaggagcccctctgcctggctgcccagtctggaaagtgaggagcgtctctacccggccgccatcccatctaggaagtgaggagcgcctcttcccggccaccatcacatctgggaagtgaggagcgtctctgccctgccgcccatcgtctgagatgtggggagcacctctgccctgccgccccgtccgggatgtgaggagcgtctctgcccggacgccccgtctgagaagtgaggagaccctctgcctggcaaccgccccgtctgagaatgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtga

SEQ ID NO: 9244 - DNA, 2766 bp, Artificial Sequence
  Synthetic polypeptide
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactag

SEQ ID NO: 9245 - DNA, 496 bp, Artificial Sequence
  Synthetic polypeptide
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtgg

SEQ ID NO: 9246 - DNA, 473 bp, Artificial Sequence
  Synthetic polypeptide
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatga

SEQ ID NO: 9247 - DNA, 449 bp, Artificial Sequence
  Synthetic polypeptide
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcataga

SEQ ID NO: 9248 - DNA, 378 bp, Artificial Sequence
  Synthetic polypeptide
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttg

SEQ ID NO: 9249 - DNA, 333 bp, Artificial Sequence
  Synthetic polypeptide
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagatacctt

SEQ ID NO: 9250 - DNA, 136 bp, Artificial Sequence
  Synthetic polypeptide
ggccaggtgcagtgactcatgcctgtaatcccagcactttgggaggccaaggcaggtggattgcttgagcccgggagtttgagaccagcctgggcaacatgacaaatggtggcccggagtttgctcgataccttga

SEQ ID NO: 9251 - DNA, 390 bp, Artificial Sequence
  Synthetic polypeptide
ctcccactgattctacattatgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaa

SEQ ID NO: 9252 - DNA, 667 bp, Artificial Sequence
  Synthetic polypeptide
gctgggtacagtggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactga

SEQ ID NO: 9253 - DNA, 4599 bp, Artificial Sequence; identical to SEQ ID NO: 8376
  Synthetic polypeptide

SEQ ID NO: 9254 - DNA, 2243 bp, Artificial Sequence; identical to SEQ ID NO: 8048
  Synthetic polypeptide

SEQ ID NO: 9255 - DNA, 1338 bp, Artificial Sequence; identical to SEQ ID NO: 8049
  Synthetic polypeptide

SEQ ID NO: 9256 - DNA, 1263 bp, Artificial Sequence; identical to SEQ ID NO: 8050
  Synthetic polypeptide

SEQ ID NO: 9257 - DNA, 2658 bp, Artificial Sequence
  Synthetic polypeptide
tttccacggtctccctctcatgccgagccgaagctggacggtactgctgccatctcggctcactgcaacctccctgcctgattctcctgcctcagcttgccgagtgcctgcgattgcaggtgcacgccgccacgcctgactggttttcgtattttcttggtggagactgggattcgctgtgttggccgggctggtctccagctcctaaccgcgagtgatccgacagcctcggcctcccgaggtgccgggattgcagacggagtctcgttcattcagtgctcaatggtgcccaggctggagtgcagtggcgtgatcttggctcgtgcaacctccacctcccagcagcctgccttggcctcccaaagtgccgagattgcagcctctgcccggccgccaccccgtctgggaagtgaggagcttctccgcctggccgcctatcgtctgggatgtgaggagcccctctgcctggctgcccagtctggaaagtgaggagcgtctctacccggccgccatcccatctaggaagtgaggagcgcctcttcccggccaccatcacatctgggaagtgaggagcgtctctgccctgccgcccatcgtctgagatgtggggagcacctctgccctgccgccccgtccgggatgtgaggagcgtctctgcccggacgccccgtctgagaatgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtga

SEQ ID NO: 9258 - DNA, 3055 bp, Artificial Sequence; identical to SEQ ID NO: 709
  Synthetic polypeptide

SEQ ID NO: 9259 - DNA, 3058 bp, Artificial Sequence; identical to SEQ ID NO: 710
  Synthetic polypeptide

SEQ ID NO: 9260 - DNA, 839 bp, Artificial Sequence; identical to SEQ ID NO: 9123
  Synthetic polypeptide

SEQ ID NO: 9261 - DNA, 2578 bp, Artificial Sequence; identical to SEQ ID NO: 7194
  Synthetic polypeptide

SEQ ID NO: 9262 - DNA, 2305 bp, Artificial Sequence; identical to SEQ ID NO: 7195
  Synthetic polypeptide

SEQ ID NO: 9263 - DNA, 1759 bp, Artificial Sequence; identical to SEQ ID NO: 7196
  Synthetic polypeptide

SEQ ID NO: 9264 - DNA, 238 bp, Artificial Sequence; identical to SEQ ID NO: 6628
  Synthetic polypeptide

SEQ ID NO: 9265 - DNA, 1636 bp, Artificial Sequence; identical to SEQ ID NO: 531
  Synthetic polypeptide

SEQ ID NO: 9266 - DNA, 1328 bp, Artificial Sequence; identical to SEQ ID NO: 532
  Synthetic polypeptide

SEQ ID NO: 9267 - DNA, 1052 bp, Artificial Sequence; identical to SEQ ID NO: 447
  Synthetic polypeptide

SEQ ID NO: 9268 - DNA, 1118 bp, Artificial Sequence; identical to SEQ ID NO: 448
  Synthetic polypeptide

SEQ ID NO: 9269 - DNA, 2297 bp, Artificial Sequence; identical to SEQ ID NO: 7386
  Synthetic polypeptide

SEQ ID NO: 9270 - DNA, 2447 bp, Artificial Sequence; identical to SEQ ID NO: 7387
  Synthetic polypeptide

SEQ ID NO: 9271 - DNA, 2312 bp, Artificial Sequence; identical to SEQ ID NO: 7388
  Synthetic polypeptide

SEQ ID NO: 9272 - DNA, 2375 bp, Artificial Sequence; identical to SEQ ID NO: 7389
  Synthetic polypeptide

SEQ ID NO: 9273 - DNA, 2093 bp, Artificial Sequence; identical to SEQ ID NO: 7390
  Synthetic polypeptide

SEQ ID NO: 9274 - DNA, 2090 bp, Artificial Sequence; identical to SEQ ID NO: 7391
  Synthetic polypeptide

SEQ ID NO: 9275 - DNA, 3882 bp, Artificial Sequence; identical to SEQ ID NO: 8381
  Synthetic polypeptide

SEQ ID NO: 9276 - DNA, 4011 bp, Artificial Sequence; identical to SEQ ID NO: 8382
  Synthetic polypeptide

SEQ ID NO: 9277 - DNA, 1060 bp, Artificial Sequence; identical to SEQ ID NO: 8383
  Synthetic polypeptide

SEQ ID NO: 9278 - DNA, 5464 bp, Artificial Sequence; identical to SEQ ID NO: 7409
  Synthetic polypeptide

SEQ ID NO: 9279 - DNA, 4444 bp, Artificial Sequence; identical to SEQ ID NO: 7410
  Synthetic polypeptide

SEQ ID NO: 9280 - DNA, 574 bp, Artificial Sequence; identical to SEQ ID NO: 7411
  Synthetic polypeptide

SEQ ID NO: 9281 - DNA, 503 bp, Artificial Sequence; identical to SEQ ID NO: 493
  Synthetic polypeptide

SEQ ID NO: 9282 - DNA, 476 bp, Artificial Sequence; identical to SEQ ID NO: 495
  Synthetic polypeptide

SEQ ID NO: 9283 - DNA, 539 bp, Artificial Sequence; identical to SEQ ID NO: 496
  Synthetic polypeptide

SEQ ID NO: 9284 - DNA, 1795 bp, Artificial Sequence; identical to SEQ ID NO: 879
  Synthetic polypeptide

SEQ ID NO: 9285 - DNA, 1171 bp, Artificial Sequence; identical to SEQ ID NO: 880
  Synthetic polypeptide

SEQ ID NO: 9286 - DNA, 445 bp, Artificial Sequence; identical to SEQ ID NO: 744
  Synthetic polypeptide

SEQ ID NO: 9287 - DNA, 59 bp, Artificial Sequence; identical to SEQ ID NO: 742
  Synthetic polypeptide

SEQ ID NO: 9288 - DNA, 123 bp, Artificial Sequence; identical to SEQ ID NO: 743
  Synthetic polypeptide

SEQ ID NO: 9289 - DNA, 3551 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaa

SEQ ID NO: 9290 - DNA, 3464 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaatttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaa

SEQ ID NO: 9291 - DNA, 3491 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatga

SEQ ID NO: 9292 - DNA, 1092 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcagg

SEQ ID NO: 9293 - DNA, 1038 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatg

SEQ ID NO: 9294 - DNA, 3398 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttga

SEQ ID NO: 9295 - DNA, 3581 bp, Artificial Sequence
  Synthetic polypeptide
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaa

SEQ ID NO: 9296 - DNA, 1815 bp, Artificial Sequence; identical to SEQ ID NO: 581
  Synthetic polypeptide

SEQ ID NO: 9297 - DNA, 463 bp, Artificial Sequence; identical to SEQ ID NO: 7109
  Synthetic polypeptide

SEQ ID NO: 9298 - DNA, 394 bp, Artificial Sequence; identical to SEQ ID NO: 701
  Synthetic polypeptide

SEQ ID NO: 9299 - DNA, 700 bp, Artificial Sequence; identical to SEQ ID NO: 702
  Synthetic polypeptide

SEQ ID NO: 9300 - DNA, 568 bp, Artificial Sequence; identical to SEQ ID NO: 703
  Synthetic polypeptide

SEQ ID NO: 9301 - DNA, 535 bp, Artificial Sequence; identical to SEQ ID NO: 704
  Synthetic polypeptide

SEQ ID NO: 9302 - DNA, 129 bp, Artificial Sequence; identical to SEQ ID NO: 705
  Synthetic polypeptide

SEQ ID NO: 9303 - DNA, 435 bp, Artificial Sequence; identical to SEQ ID NO: 706
  Synthetic polypeptide

SEQ ID NO: 9304 - DNA, 303 bp, Artificial Sequence; identical to SEQ ID NO: 707
  Synthetic polypeptide

SEQ ID NO: 9305 - DNA, 270 bp, Artificial Sequence; identical to SEQ ID NO: 708
  Synthetic polypeptide

SEQ ID NO: 9306 - DNA, 1967 bp, Artificial Sequence; identical to SEQ ID NO: 7428
  Synthetic polypeptide

SEQ ID NO: 9307 - DNA, 1142 bp, Artificial Sequence; identical to SEQ ID NO: 7429
  Synthetic polypeptide

SEQ ID NO: 9308 - DNA, 1490 bp, Artificial Sequence; identical to SEQ ID NO: 7414
  Synthetic polypeptide

SEQ ID NO: 9309 - DNA, 1031 bp, Artificial Sequence; identical to SEQ ID NO: 7415
  Synthetic polypeptide

SEQ ID NO: 9310 - DNA, 1079 bp, Artificial Sequence; identical to SEQ ID NO: 7416
  Synthetic polypeptide

SEQ ID NO: 9311 - DNA, 1443 bp, Artificial Sequence; identical to SEQ ID NO: 6760
  Synthetic polypeptide

SEQ ID NO: 9312 - DNA, 984 bp, Artificial Sequence; identical to SEQ ID NO: 6761
  Synthetic polypeptide

SEQ ID NO: 9313 - DNA, 1032 bp, Artificial Sequence; identical to SEQ ID NO: 6762
  Synthetic polypeptide

SEQ ID NO: 9314 - DNA, 1392 bp, Artificial Sequence; identical to SEQ ID NO: 6782
  Synthetic polypeptide

SEQ ID NO: 9315 - DNA, 933 bp, Artificial Sequence; identical to SEQ ID NO: 6783
  Synthetic polypeptide

SEQ ID NO: 9316 - DNA, 981 bp, Artificial Sequence; identical to SEQ ID NO: 6784
  Synthetic polypeptide

SEQ ID NO: 9317 - DNA, 3591 bp, Artificial Sequence; identical to SEQ ID NO: 8632
  Synthetic polypeptide

SEQ ID NO: 9318 - DNA, 3504 bp, Artificial Sequence; identical to SEQ ID NO: 8633
  Synthetic polypeptide

SEQ ID NO: 9319 - DNA, 3531 bp, Artificial Sequence; identical to SEQ ID NO: 8634
  Synthetic polypeptide

SEQ ID NO: 9320 - DNA, 1132 bp, Artificial Sequence; identical to SEQ ID NO: 8635
  Synthetic polypeptide

SEQ ID NO: 9321 - DNA, 1078 bp, Artificial Sequence; identical to SEQ ID NO: 8636
  Synthetic polypeptide

SEQ ID NO: 9322 - DNA, 3438 bp, Artificial Sequence; identical to SEQ ID NO: 8637
  Synthetic polypeptide

SEQ ID NO: 9323 - DNA, 3621 bp, Artificial Sequence; identical to SEQ ID NO: 8638
  Synthetic polypeptide

SEQ ID NO: 9324 - DNA, 1498 bp, Artificial Sequence; identical to SEQ ID NO: 8305
  Synthetic polypeptide

SEQ ID NO: 9325 - DNA, 1195 bp, Artificial Sequence; identical to SEQ ID NO: 8306
  Synthetic polypeptide

SEQ ID NO: 9326 - DNA, 1462 bp, Artificial Sequence; identical to SEQ ID NO: 8307
  Synthetic polypeptide

SEQ ID NO: 9327 - DNA, 1489 bp, Artificial Sequence; identical to SEQ ID NO: 8308
  Synthetic polypeptide

SEQ ID NO: 9328 - DNA, 1180 bp, Artificial Sequence; identical to SEQ ID NO: 8309
  Synthetic polypeptide

SEQ ID NO: 9329 - DNA, 1257 bp, Artificial Sequence; identical to SEQ ID NO: 625
  Synthetic polypeptide

SEQ ID NO: 9330 - DNA, 1215 bp, Artificial Sequence; identical to SEQ ID NO: 626
  Synthetic polypeptide

SEQ ID NO: 9331 - DNA, 507 bp, Artificial Sequence; identical to SEQ ID NO: 628
  Synthetic polypeptide

SEQ ID NO: 9332 - DNA, 313 bp, Artificial Sequence; identical to SEQ ID NO: 629
  Synthetic polypeptide

SEQ ID NO: 9333 - DNA, 291 bp, Artificial Sequence; identical to SEQ ID NO: 630
  Synthetic polypeptide

SEQ ID NO: 9334 - DNA, 1239 bp, Artificial Sequence
  Synthetic polypeptide
ctctccctctccctctccctctccctcgccctctcccctttccacggtctcccctctccctctctttccacggtctccctctcacgccgagccgaagctggactgtactgccgccatctcggctcactgcagcctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccacgagtgatccgccagcctcggcctcctgaggtgccgggattgcagacagagtctcgttaactcagtgctcaatggtgcccaggctggagtgcagtggcgtgatctcggctccctgcagcctccacctcccagccgcctgccttggccccccacagtgccgagattgcagcctctgcccggccgccactccgtctgggaagtgaggagcgtctctgcctggccgcccatcgtctgggatgtgaggagcccctctgcctggctgcccagtctggaaagtgaggagcctctctgcccggccgccatcccacctaggaagtgaggagcgcctcttcccggccgccatcccatctaggaagtgaggagcgtctctgcccggccgccccgtctgagaagtgaggagaccctccgcctggcaactgccccgtctgagaagtgaggagcccctccgcccggcagctgccccgtctgagaagtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtga

SEQ ID NO: 9335 - DNA, 223 bp, Artificial Sequence; identical to SEQ ID NO: 8494
  Synthetic polypeptide

SEQ ID NO: 9336 - DNA, 2725 bp, Artificial Sequence; identical to SEQ ID NO: 6753
  Synthetic polypeptide

SEQ ID NO: 9337 - DNA, 365 bp, Artificial Sequence; identical to SEQ ID NO: 7364
  Synthetic polypeptide

SEQ ID NO: 9338 - DNA, 1418 bp, Artificial Sequence; identical to SEQ ID NO: 8571
  Synthetic polypeptide

SEQ ID NO: 9339 - DNA, 1043 bp, Artificial Sequence; identical to SEQ ID NO: 8639
  Synthetic polypeptide

SEQ ID NO: 9340 - DNA, 366 bp, Artificial Sequence; identical to SEQ ID NO: 8640
  Synthetic polypeptide

SEQ ID NO: 9341 - DNA, 1579 bp, Artificial Sequence; identical to SEQ ID NO: 7461
  Synthetic polypeptide

SEQ ID NO: 9342 - DNA, 1504 bp, Artificial Sequence; identical to SEQ ID NO: 7462
  Synthetic polypeptide

SEQ ID NO: 9343 - DNA, 1002 bp, Artificial Sequence; identical to SEQ ID NO: 872
  Synthetic polypeptide

SEQ ID NO: 9344 - DNA, 897 bp, Artificial Sequence; identical to SEQ ID NO: 873
  Synthetic polypeptide

SEQ ID NO: 9345 - DNA, 836 bp, Artificial Sequence; identical to SEQ ID NO: 874
  Synthetic polypeptide

SEQ ID NO: 9346 - DNA, 528 bp, Artificial Sequence; identical to SEQ ID NO: 875
  Synthetic polypeptide

SEQ ID NO: 9347 - DNA, 1232 bp, Artificial Sequence; identical to SEQ ID NO: 6566
  Synthetic polypeptide

SEQ ID NO: 9348 - DNA, 497 bp, Artificial Sequence; identical to SEQ ID NO: 6567
  Synthetic polypeptide

SEQ ID NO: 9349 - DNA, 575 bp, Artificial Sequence; identical to SEQ ID NO: 6568
  Synthetic polypeptide

SEQ ID NO: 9350 - DNA, 4522 bp, Artificial Sequence; identical to SEQ ID NO: 8450
  Synthetic polypeptide

SEQ ID NO: 9351 - DNA, 2322 bp, Artificial Sequence; identical to SEQ ID NO: 7493
  Synthetic polypeptide

SEQ ID NO: 9352 - DNA, 1698 bp, Artificial Sequence; identical to SEQ ID NO: 7494
  Synthetic polypeptide

SEQ ID NO: 9353 - DNA, 811 bp, Artificial Sequence; identical to SEQ ID NO: 7500
  Synthetic polypeptide

SEQ ID NO: 9354 - DNA, 829 bp, Artificial Sequence; identical to SEQ ID NO: 624
  Synthetic polypeptide

SEQ ID NO: 9355 - DNA, 882 bp, Artificial Sequence
  Synthetic polypeptide
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 9356 - DNA, 807 bp, Artificial Sequence; identical to SEQ ID NO: 7401
  Synthetic polypeptide

SEQ ID NO: 9357 - DNA, 453 bp, Artificial Sequence; identical to SEQ ID NO: 7402
  Synthetic polypeptide

SEQ ID NO: 9358 - DNA, 1062 bp, Artificial Sequence; identical to SEQ ID NO: 8340
  Synthetic polypeptide

SEQ ID NO: 9359 - DNA, 1218 bp, Artificial Sequence; identical to SEQ ID NO: 8394
  Synthetic polypeptide

SEQ ID NO: 9360 - DNA, 1053 bp, Artificial Sequence; identical to SEQ ID NO: 8395
  Synthetic polypeptide

SEQ ID NO: 9361 - DNA, 942 bp, Artificial Sequence; identical to SEQ ID NO: 8396
  Synthetic polypeptide

SEQ ID NO: 9362 - DNA, 1091 bp, Artificial Sequence; identical to SEQ ID NO: 8397
  Synthetic polypeptide

SEQ ID NO: 9363 - DNA, 1291 bp, Artificial Sequence
  Synthetic polypeptide
cagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctgtaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggcggagaccccgtctgggaggtgaggagcgtctctgcccggccgccccgtctgagaagtgaggagaccctctgcctggcaaccaccccgtctgagaagtgaggagcccctccgcccggcagctgccccgtctgagaactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctga

SEQ ID NO: 9364 - DNA, 959 bp, Artificial Sequence; identical to SEQ ID NO: 8691
  Synthetic polypeptide

SEQ ID NO: 9365 - DNA, 3401 bp, Artificial Sequence; identical to SEQ ID NO: 8199
  Synthetic polypeptide

SEQ ID NO: 9366 - DNA, 3155 bp, Artificial Sequence; identical to SEQ ID NO: 8200
  Synthetic polypeptide

SEQ ID NO: 9367 - DNA, 233 bp, Artificial Sequence; identical to SEQ ID NO: 856
  Synthetic polypeptide

SEQ ID NO: 9368 - DNA, 2419 bp, Artificial Sequence; identical to SEQ ID NO: 7455
  Synthetic polypeptide

SEQ ID NO: 9369 - DNA, 1222 bp, Artificial Sequence; identical to SEQ ID NO: 6653
  Synthetic polypeptide

SEQ ID NO: 9370 - DNA, 451 bp, Artificial Sequence; identical to SEQ ID NO: 6654
  Synthetic polypeptide

SEQ ID NO: 9371 - DNA, 292 bp, Artificial Sequence; identical to SEQ ID NO: 6655
  Synthetic polypeptide

SEQ ID NO: 9372 - DNA, 504 bp, Artificial Sequence; identical to SEQ ID NO: 6656
  Synthetic polypeptide

SEQ ID NO: 9373 - DNA, 449 bp, Artificial Sequence; identical to SEQ ID NO: 6657
  Synthetic polypeptide

SEQ ID NO: 9374 - DNA, 454 bp, Artificial Sequence; identical to SEQ ID NO: 6658
  Synthetic polypeptide

SEQ ID NO: 9375 - DNA, 287 bp, Artificial Sequence; identical to SEQ ID NO: 7101
  Synthetic polypeptide

SEQ ID NO: 9376 - DNA, 281 bp, Artificial Sequence; identical to SEQ ID NO: 7102
  Synthetic polypeptide

SEQ ID NO: 9377 - DNA, 74 bp, Artificial Sequence; identical to SEQ ID NO: 7010
  Synthetic polypeptide

SEQ ID NO: 9378 - DNA, 1224 bp, Artificial Sequence; identical to SEQ ID NO: 6690
  Synthetic polypeptide

SEQ ID NO: 9379 - DNA, 842 bp, Artificial Sequence; identical to SEQ ID NO: 6534
  Synthetic polypeptide

SEQ ID NO: 9380 - DNA, 331 bp, Artificial Sequence; identical to SEQ ID NO: 8434
  Synthetic polypeptide

SEQ ID NO: 9381 - DNA, 1538 bp, Artificial Sequence; identical to SEQ ID NO: 8435
  Synthetic polypeptide

SEQ ID NO: 9382 - DNA, 884 bp, Artificial Sequence; identical to SEQ ID NO: 8436
  Synthetic polypeptide

SEQ ID NO: 9383 - DNA, 343 bp, Artificial Sequence; identical to SEQ ID NO: 8437
  Synthetic polypeptide

SEQ ID NO: 9384 - DNA, 401 bp, Artificial Sequence; identical to SEQ ID NO: 8438
  Synthetic polypeptide

SEQ ID NO: 9385 - DNA, 1535 bp, Artificial Sequence; identical to SEQ ID NO: 8439
  Synthetic polypeptide

SEQ ID NO: 9386 - DNA, 255 bp, Artificial Sequence; identical to SEQ ID NO: 8440
  Synthetic polypeptide

SEQ ID NO: 9387 - DNA, 88 bp, Artificial Sequence; identical to SEQ ID NO: 8441
  Synthetic polypeptide

SEQ ID NO: 9388 - DNA, 429 bp, Artificial Sequence; identical to SEQ ID NO: 8442
  Synthetic polypeptide

SEQ ID NO: 9389 - DNA, 1022 bp, Artificial Sequence; identical to SEQ ID NO: 590
  Synthetic polypeptide

SEQ ID NO: 9390 - DNA, 347 bp, Artificial Sequence; identical to SEQ ID NO: 591
  Synthetic polypeptide

SEQ ID NO: 9391 - DNA, 1109 bp, Artificial Sequence; identical to SEQ ID NO: 592
  Synthetic polypeptide

SEQ ID NO: 9392 - DNA, 85 bp, Artificial Sequence; identical to SEQ ID NO: 601
  Synthetic polypeptide

SEQ ID NO: 9393 - DNA, 269 bp, Artificial Sequence; identical to SEQ ID NO: 600
  Synthetic polypeptide

SEQ ID NO: 9394 - DNA, 1058 bp, Artificial Sequence; identical to SEQ ID NO: 7375
  Synthetic polypeptide

SEQ ID NO: 9395 - DNA, 701 bp, Artificial Sequence; identical to SEQ ID NO: 658
  Synthetic polypeptide

SEQ ID NO: 9396 - DNA, 423 bp, Artificial Sequence; identical to SEQ ID NO: 6550
  Synthetic polypeptide

SEQ ID NO: 9397 - DNA, 1340 bp, Artificial Sequence; identical to SEQ ID NO: 7107
  Synthetic polypeptide

SEQ ID NO: 9398 - DNA, 1506 bp, Artificial Sequence
  Synthetic polypeptide
cctctctttccatggtctccctctcatgcggagccggactggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccaggattgcagacggagtctcgttcactcagtgctcaatggtgcccaggctggagtgcagtggcgtgatctcggctcgctacaacctacacctcccagccgcctgccttggcctcctaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgcctcttcccagccgccatcccatctaggaagtgaggagcgcctcttcccagccgccatcacatctaggaagtgaggagcgtctctgcccggccgcccatcgtctgagatgtggggagtgcctctgccccgcggccccatctgggatgtgaggagcacctctgcccggccgcgaccccgtctgggaggtgaggagcgtctctgcccggccaccccgtctgagaagtgaggagaccctctgcctggcaaccaccccgtctgagaagtgaggagcccctccgcccggcagctgccccgtctgagaagtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttga

SEQ ID NO: 9399 - DNA, 1431 bp, Artificial Sequence
  Synthetic polypeptide
cctctctttccatggtctccctctcatgcggagccggactggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccaggattgcagacggagtctcgttcactcagtgctcaatggtgcccaggctggagtgcagtggcgtgatctcggctcgctacaacctacacctcccagccgcctgccttggcctcctaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgcctcttcccagccgccatcccatctaggaagtgaggagcgcctcttcccagccgccatcacatctaggaagtgaggagcgtctctgcccggccgcccatcgtctgagatgtggggagtgcctctgccccgcggccccatctgggatgtgaggagcacctctgcccggccgcgaccccgtctgggaggtgaggagcgtctctgcccggccaccccgtctgagaagtgaggagaccctctgcctggcaaccaccccgtctgagaagtgaggagcccctccgcccggcagctgccccgtctgagaagtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctga

SEQ ID NO: 9400 - DNA, 1002 bp, Artificial Sequence; identical to SEQ ID NO: 7528
  Synthetic polypeptide

SEQ ID NO: 9401 - DNA, 1757 bp, Artificial Sequence
  Synthetic polypeptide
ctccctctccctctcggtctccctctccctctcggtctccctctccctctctttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctctctacaacctccaactcccagccgcctgccttggcctcccaaagtgccgagagtgcagcctctgcctggccgcccatcgtctgggacgtgaggagcccctctgcctggctgcccagtctggaaagtaaggagcgtctctgcctggccgccatcccatctgggaagtgaggagcgcctcttcccggccgccatcccatctaggaagtgaggagcgtctctgcccggccgcccatcgtctgcgatgtggggagcgcctctgccccaacgccccgtctgggatgtgaggagcgcctctgcccggccacgaccccgtctgggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctga

SEQ ID NO: 9402 - DNA, 950 bp, Artificial Sequence
  Synthetic polypeptide
ctccctctccctctcggtctccctctccctctcggtctccctctccctctctttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctctctacaacctccaactcccagccgcctgccttggcctcccaaagtgccgagagtgcagcctctgcctggccgcccatcgtctgggacgtgaggagcccctctgcctggctgcccagtctggaaagtaaggagcgtctctgcctggccgccatcccatctgggaagtgaggagcgcctcttcccggccgccatcccatctaggaagtgaggagcgtctctgcccggccgcccatcgtctgcgatgtggggagcgcctctgccccaacgccccgtctgggatgtgaggagcgcctctgcccggccacgaccccgtctgggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgagagcagggcgctggtccagcccggc

SEQ ID NO: 9403 - DNA, 1259 bp, Artificial Sequence
  Synthetic polypeptide
ctccctctccctctcggtctccctctccctctcggtctccctctccctctctttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctctctacaacctccaactcccagccgcctgccttggcctcccaaagtgccgagagtgcagcctctgcctggccgcccatcgtctgggacgtgaggagcccctctgcctggctgcccagtctggaaagtaaggagcgtctctgcctggccgccatcccatctgggaagtgaggagcgcctcttcccggccgccatcccatctaggaagtgaggagcgtctctgcccggccgcccatcgtctgcgatgtggggagcgcctctgccccaacgccccgtctgggatgtgaggagcgcctctgcccggccacgaccccgtctgggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgagagcagggcgctggtccagcccggcactgagacacgggggccccagagagaagcacagaacaccttgcctctctacccagaggagcgccctggctggcagtacagttttttgatttgctggagtcccggtcaagggagaagcccagggtggttaaatgatggctctacgctcactgcctccctccaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccag

SEQ ID NO: 9404 - DNA, 2208 bp, Artificial Sequence; identical to SEQ ID NO: 8588
  Synthetic polypeptide

SEQ ID NO: 9405 - DNA, 2358 bp, Artificial Sequence; identical to SEQ ID NO: 8589
  Synthetic polypeptide

SEQ ID NO: 9406 - DNA, 2223 bp, Artificial Sequence; identical to SEQ ID NO: 8590
  Synthetic polypeptide

SEQ ID NO: 9407 - DNA, 2286 bp, Artificial Sequence; identical to SEQ ID NO: 8591
  Synthetic polypeptide

SEQ ID NO: 9408 - DNA, 2004 bp, Artificial Sequence; identical to SEQ ID NO: 8592
  Synthetic polypeptide

SEQ ID NO: 9409 - DNA, 2001 bp, Artificial Sequence; identical to SEQ ID NO: 8593
  Synthetic polypeptide

SEQ ID NO: 9410 - DNA, 673 bp, Artificial Sequence
  Synthetic polypeptide
gccgccccgtccgggaggcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatga

SEQ ID NO: 9411 - DNA, 704 bp, Artificial Sequence
  Synthetic polypeptide
tttcctgcatgaaagcagcacatgttgttctctcggcctggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatga

SEQ ID NO: 9412 - DNA, 3959 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtga

SEQ ID NO: 9413 - DNA, 4088 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtga

SEQ ID NO: 9414 - DNA, 1137 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 9415 - DNA, 943 bp, Artificial Sequence; identical to SEQ ID NO: 6540
  Synthetic polypeptide

SEQ ID NO: 9416 - DNA, 1007 bp, Artificial Sequence; identical to SEQ ID NO: 7489
  Synthetic polypeptide

SEQ ID NO: 9417 - DNA, 806 bp, Artificial Sequence; identical to SEQ ID NO: 8266
  Synthetic polypeptide

SEQ ID NO: 9418 - DNA, 1376 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 9419 - DNA, 1211 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 9420 - DNA, 1100 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 9421 - DNA, 1249 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 9422 - DNA, 809 bp, Artificial Sequence; identical to SEQ ID NO: 8505
  Synthetic polypeptide

SEQ ID NO: 9423 - DNA, 809 bp, Artificial Sequence; identical to SEQ ID NO: 8506
  Synthetic polypeptide

SEQ ID NO: 9424 - DNA, 1927 bp, Artificial Sequence; identical to SEQ ID NO: 8368
  Synthetic polypeptide

SEQ ID NO: 9425 - DNA, 1458 bp, Artificial Sequence
  Synthetic polypeptide
ctccttccacggtctccctctgatgccgagccaaagctggacggtactgctgccatctcggctcactgcaacctccctgcctgattctcctgcctcagcctgccgagggcctgcgattgcaggcgcgcgccaccacgcctgactggttttcgtacttttttggtggagacggggtttcactgtgttggccgggctggtctccagctcctaaccgcgagtgatccgccagccttggcctcccaaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcctggccgccaccccgtctgggaagtgaggagcgtctctgcctggccgcccatcgtctgggatacgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagtgaggagcccctccgtccggcagccaccccgtctgggaagcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatga

SEQ ID NO: 9426 - DNA, 771 bp, Artificial Sequence
  Synthetic polypeptide
cagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 9427 - DNA, 814 bp, Artificial Sequence; identical to SEQ ID NO: 8476
  Synthetic polypeptide

SEQ ID NO: 9428 - DNA, 1348 bp, Artificial Sequence; identical to SEQ ID NO: 8477
  Synthetic polypeptide

SEQ ID NO: 9429 - DNA, 1084 bp, Artificial Sequence; identical to SEQ ID NO: 580
  Synthetic polypeptide

SEQ ID NO: 9430 - DNA, 2636 bp, Artificial Sequence; identical to SEQ ID NO: 8432
  Synthetic polypeptide

SEQ ID NO: 9431 - DNA, 3776 bp, Artificial Sequence; identical to SEQ ID NO: 8433
  Synthetic polypeptide

SEQ ID NO: 9432 - DNA, 2471 bp, Artificial Sequence; identical to SEQ ID NO: 576
  Synthetic polypeptide

SEQ ID NO: 9433 - DNA, 2822 bp, Artificial Sequence
  Synthetic polypeptide
aaagctgtgtggatggagcccttagagagagcaggctgtcttgcagagccctagaacctgccattccgtggacctggaaggcagagcatcaaaccaaacagagctattctcaagccttataagccttaagatgtgacagaatttaccttaataagttttggatttgcttgggacccatcacccttgctttctttcctatatctcctttttggaataagacgtccatcctatgcctgtcccaccattgtattatggaaaagaaacatgtagctcaactggtttcacaagttcacagctggtgatgaatttgccttatcatgaatcacacctctagtctcatctacgtctgatttggacaatgtttagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattag

SEQ ID NO: 9434 - DNA, 639 bp, Artificial Sequence
  Synthetic polypeptide
gcctggtgtggtggtgcatgtctgtagtatcagctacttgggaggctgagattgcaagatctcttgagcccaggagttggaggccagcctgggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccg

SEQ ID NO: 9435 - DNA, 547 bp, Artificial Sequence
  Synthetic polypeptide
gcctggtgtggtggtgcatgtctgtagtatcagctacttgggaggctgagattgcaagatctcttgagcccaggagttggaggccagcctgggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcct

SEQ ID NO: 9436 - DNA, 449 bp, Artificial Sequence
  Synthetic polypeptide
gcctggtgtggtggtgcatgtctgtagtatcagctacttgggaggctgagattgcaagatctcttgagcccaggagttggaggccagcctgggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccc

SEQ ID NO: 9437 - DNA, 809 bp, Artificial Sequence; identical to SEQ ID NO: 8586
  Synthetic polypeptide

SEQ ID NO: 9438 - DNA, 809 bp, Artificial Sequence; identical to SEQ ID NO: 8587
  Synthetic polypeptide

SEQ ID NO: 9439 - DNA, 809 bp, Artificial Sequence; identical to SEQ ID NO: 8613
  Synthetic polypeptide

SEQ ID NO: 9440 - DNA, 7177 bp, Artificial Sequence; identical to SEQ ID NO: 574
  Synthetic polypeptide

SEQ ID NO: 9441 - DNA, 7195 bp, Artificial Sequence; identical to SEQ ID NO: 575
  Synthetic polypeptide

SEQ ID NO: 9442 - DNA, 175 bp, Artificial Sequence
  Synthetic polypeptide
gaaaagagactggaaggaaacagcacaacagaagcagcatttgtctccggggtgtggaggctggtggcccctgcccacacccccacacctgcaggcggagccagagaaccaccagtaccaggacctgctaaaccccgaccctgccccctactgccagctggtgccaacttcctga

SEQ ID NO: 9443 - DNA, 178 bp, Artificial Sequence
  Synthetic polypeptide
gaaaagagactggaaggaaacagcacaacagaagcagcatttgtctccggggtgtggaggctggtggcccctgcccacacccccacacctgcaggcggagccagagaaccaccagtaccagcaggacctgctaaaccccgaccctgccccctactgccagctggtgccaacttcctga

SEQ ID NO: 9444 - DNA, 921 bp, Artificial Sequence; identical to SEQ ID NO: 8811
  Synthetic polypeptide

SEQ ID NO: 9445 - DNA, 809 bp, Artificial Sequence; identical to SEQ ID NO: 8505
  Synthetic polypeptide

SEQ ID NO: 9446 - DNA, 852 bp, Artificial Sequence; identical to SEQ ID NO: 753
  Synthetic polypeptide

SEQ ID NO: 9447 - DNA, 281 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacct

SEQ ID NO: 9448 - DNA, 990 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctga

SEQ ID NO: 9449 - DNA, 338 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccg

SEQ ID NO: 9450 - DNA, 367 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatat

SEQ ID NO: 9451 - DNA, 197 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctga

SEQ ID NO: 9452 - DNA, 813 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgggaaaactatatccacagaatcggtcgaggtggacggtttggccgtaa

SEQ ID NO: 9453 - DNA, 583 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgcca

SEQ ID NO: 9454 - DNA, 795 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgaatcggtcgaggtggacggtttggccgtaa

SEQ ID NO: 9455 - DNA, 588 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacc

SEQ ID NO: 9456 - DNA, 379 bp, Artificial Sequence
  Synthetic polypeptide
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctca

SEQ ID NO: 9457 - DNA, 1334 bp, Artificial Sequence
  Synthetic polypeptide
aaagagcccctaaatgcagcgcctctgccctgtctgggaagtgaggagcgcctctgcccagtcgtcaactgtctgggaagtggggagcacttctgcctggccactgccccatctgggaatgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggacttttggaggccaaggcaagaggattgcttgaggccaggagtttgagaccagcctgggcaacatag

SEQ ID NO: 9458 - DNA, 701 bp, Artificial Sequence
  Synthetic polypeptide
aaagagcccctaaatgcagcgcctctgccctgtctgggaagtgaggagcgcctctgcccagtcgtcaactgtctgggaagtggggagcacttctgcctggccactgccccatctgggaatgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaaggcatttcactgaaagcagaagctgtctcagtcaagaaagaatcagaagatcctaa

SEQ ID NO: 9459 - DNA, 2870 bp, Artificial Sequence
  Synthetic polypeptide
aaagagcccctaaatgcagcgcctctgccctgtctgggaagtgaggagcgcctctgcccagtcgtcaactgtctgggaagtggggagcacttctgcctggccactgccccatctgggaatgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatacggaaagaatgcgtgacgagaagcttcacgagctgaaaaaagggctcaggaagtatctcttaggctcgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatctttttgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtga

SEQ ID NO: 9460 - DNA, 809 bp, Artificial Sequence; identical to SEQ ID NO: 8643
  Synthetic polypeptide

SEQ ID NO: 9461 - DNA, 117 bp, Artificial Sequence
  Synthetic polypeptide
ccttcctctttcccttccaagggctggtgtgagttgcagtttcttctccttgcaaaacatctgaagaaaatctcagtgttcctggtacatggtaggatcaacttcctgaccttgtga

SEQ ID NO: 9462 - DNA, 809 bp, Artificial Sequence; identical to SEQ ID NO: 8699
  Synthetic polypeptide

SEQ ID NO: 9463 - DNA, 127 bp, Artificial Sequence; identical to SEQ ID NO: 8697
  Synthetic polypeptide

SEQ ID NO: 9464 - DNA, 333 bp, Artificial Sequence; identical to SEQ ID NO: 6583
  Synthetic polypeptide

SEQ ID NO: 9465 - DNA, 809 bp, Artificial Sequence; identical to SEQ ID NO: 8699
  Synthetic polypeptide

SEQ ID NO: 9466 - DNA, 463 bp, Artificial Sequence; identical to SEQ ID NO: 524
  Synthetic polypeptide

SEQ ID NO: 9467 - DNA, 1093 bp, Artificial Sequence; identical to SEQ ID NO: 7796
  Synthetic polypeptide

SEQ ID NO: 9468 - DNA, 771 bp, Artificial Sequence; identical to SEQ ID NO: 8620
  Synthetic polypeptide

SEQ ID NO: 9469 - DNA, 720 bp, Artificial Sequence; identical to SEQ ID NO: 8621
  Synthetic polypeptide

SEQ ID NO: 9470 - DNA, 464 bp, Artificial Sequence; identical to SEQ ID NO: 8622
  Synthetic polypeptide

SEQ ID NO: 9471 - DNA, 112 bp, Artificial Sequence; identical to SEQ ID NO: 7120
  Synthetic polypeptide

SEQ ID NO: 9472 - DNA, 509 bp, Artificial Sequence; identical to SEQ ID NO: 7445
  Synthetic polypeptide

SEQ ID NO: 9473 - DNA, 285 bp, Artificial Sequence; identical to SEQ ID NO: 6932
  Synthetic polypeptide

SEQ ID NO: 9474 - DNA, 333 bp, Artificial Sequence; identical to SEQ ID NO: 6933
  Synthetic polypeptide

SEQ ID NO: 9475 - DNA, 207 bp, Artificial Sequence; identical to SEQ ID NO: 6934
  Synthetic polypeptide

SEQ ID NO: 9476 - DNA, 555 bp, Artificial Sequence; identical to SEQ ID NO: 6935
  Synthetic polypeptide

SEQ ID NO: 9477 - DNA, 225 bp, Artificial Sequence; identical to SEQ ID NO: 6936
  Synthetic polypeptide

SEQ ID NO: 9478 - DNA, 2747 bp, Artificial Sequence; identical to SEQ ID NO: 8475
  Synthetic polypeptide

SEQ ID NO: 9479 - DNA, 809 bp, Artificial Sequence; identical to SEQ ID NO: 8643
  Synthetic polypeptide

SEQ ID NO: 9480 - DNA, 1346 bp, Artificial Sequence; identical to SEQ ID NO: 7758
  Synthetic polypeptide

SEQ ID NO: 9481 - DNA, 369 bp, Artificial Sequence; identical to SEQ ID NO: 6492
  Synthetic polypeptide

SEQ ID NO: 9482 - DNA, 1671 bp, Artificial Sequence
  Synthetic polypeptide
gcaggggttccagggccaggccatttccgctggcgcaggactctgctagcagcaacctgcctgaagtcttcctttggcctggctgagagtttctgagacctgcgctggagcggagacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtga

SEQ ID NO: 9483 - DNA, 1642 bp, Artificial Sequence
  Synthetic polypeptide
cacggtctccctctcatgtggagccgaagctggactgtactgctgccatctcggctcactgcaacctccctgcctgattctcctgcctcagcctgccgagtgcctgcgattgcaggcacgcaccaccacgcctgactggttttggtggagacggggtttcgctgtgttggccgggccggtctccagcccctaaccgcgagtgatccgccagccttggcctcccgaggtgccgggattgcagacggagtctcgttcactcagtgctcaatggtgcccaggctggagtgcagtggcgtgatctcggctcactacaacctacacctcccagcaacctgccttggcctcccaaagtgccgagattgcagcctctgcccggccgccaccccgtctgggaagtgaggagtgtctccgcctggccacccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagccgccccgtctgagaagtgaggagcctctccgcccggcagccaccccatctgggaaatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagcttggttctacatattttagggaggcatga

SEQ ID NO: 9484 - DNA, 809 bp, Artificial Sequence; identical to SEQ ID NO: 8613
  Synthetic polypeptide

SEQ ID NO: 9485 - DNA, 278 bp, Artificial Sequence; identical to SEQ ID NO: 8451
  Synthetic polypeptide

SEQ ID NO: 9486 - DNA, 136 bp, Artificial Sequence; identical to SEQ ID NO: 8452
  Synthetic polypeptide

SEQ ID NO: 9487 - DNA, 1327 bp, Artificial Sequence; identical to SEQ ID NO: 6801
  Synthetic polypeptide

SEQ ID NO: 9488 - DNA, 1505 bp, Artificial Sequence
  Synthetic polypeptide
cccctgccaggctagccgccccgtccgggagggaggtgggggggtcagccccccgcccggccagccgccccgtccgggagggaggtgggggggtcagcccccaacccggccagccgccccgtccgggaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 9489 - DNA, 1023 bp, Artificial Sequence; identical to SEQ ID NO: 611
  Synthetic polypeptide

SEQ ID NO: 9490 - DNA, 2003 bp, Artificial Sequence; identical to SEQ ID NO: 8385
  Synthetic polypeptide

SEQ ID NO: 9491 - DNA, 2293 bp, Artificial Sequence
  Synthetic polypeptide
tctccctctttccacggtctccctctgaagctggactgtactgctgccatctcagctcactgcaacctccctgcctgattctcctgcctcagcctgccgagtgcctgcgattgcaggcgcgcgccgccacgcctgactggttttcctattttttgggtggagacggggtttcgctgtgttggccgggctggtctccagctcctaaccgcgagtgatccgccagcctcggcctcccgaggtgccgggattgcagacggagtctccttcactcagtgctcaatggtgcccaggctggagtgcagtggcgtgatctcggctccctacaacatccacctcccggcagcctgccttggcctcccaaagtgccgagattgcagcctctgcccagccgccaccccatctgggaaggccgccaccccgtctgggaagtgaggagcgtctctgcctggccgcccatcgtctgggatgtgaggagcccctctgcctggctgcccagtctggaaagtgaggagcatctctgcccagccgccatcccatctaggaagtgagaagcgcctcttcccggccgccatcccatctaggaagtgaggagcgtctctgcccggccacccatcgtctgagatgtggggagcgcctctgccctgtcgccccgtccgggatgtgaggagcgtctctgcctggccacctcgtctgagaagtgaggagaccctctgcctggcaaccgccctgtctgagaagtgaggagcccctccgcccagcagccgccccgtctgagaagtgaggagcccctctgcccggcagccaccccgtctgggaagtgaggagcgtctccgcccggcagccacccgtccgggagggaggtgggggtgtcagtcccccgcctggccagccgcctcgtccgggaggttccgacacaaaaaggactgtccatgaatttattaatgaccagagagacaggtttctgctcgagtatgctttgtcaaccaaaagaaacacaatcaaaaagtttgaaaaagacatagcaatgagggaacggcaactaaaaaaagcagagaaaaagctccaagatgatgcactggcctttgaagagttccttcgagaaaatgaccagagatctgtagacgctctgaaaatggcagcacaggaaacaataaacaaactccaaatgacagcagagctgaagaaagcaagcatggaggtacaagcagtgaaaagtgaaatagcaaaaacagaattcctcctcagggagtatatgaaatatggtttttttctgctgcaaatgtctccaaaacattggcaaatccagcaagcactaaaaagagcacaggcatcaaaaagtaaagcaaatatcatccttccaaaaatattagcaaaattatcattacattcaagtaacaaggaaggcatccttgaggagtccgggaggacagctgtcctttcagaagatgcttctcagggaagagacagccaaggaaagccaagcagaagcctgactcgcactccagagaaaaagaaatcaaacctggctgaaagtttcggttcagaagacagtttggaattccttttagatgatgaaatggacgttgatttggagccagcactttatttcaaggaaccagaggagttacttcaagtcctcagagagctggaagagcagaatcttactttgtttcaatattcccaagatgtagatgaaaatcttgaagaggtaaacaaaagagaaaaagttatacaggataaaacaaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtaaaagtagaatctcgcctggtagaactgtgtgacctcatcgaatccattcccaaagaaaatgtggaggcaattgagaggatgaaacagaaagaatggcggcaaaagtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttga

SEQ ID NO: 9492 - DNA, 956 bp, Artificial Sequence; identical to SEQ ID NO: 7135
  Synthetic polypeptide

SEQ ID NO: 9493 - DNA, 570 bp, Artificial Sequence
  Synthetic polypeptide
gaagaggcaggcatggaggggcagcttggatggcaacttccagattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtag

SEQ ID NO: 9494 - DNA, 513 bp, Artificial Sequence
  Synthetic polypeptide
gaagaggcaggcatggaggggcagcttggatggcaacttccagattgccttgggtccccagtgtttactcccatcaaggcagacataagcggcaacatcacgaaaatcaaagctgtgtacgacaccaacccagccaagttccggaccctgcagaacatcctggaggtggagaaagaaataggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtag

SEQ ID NO: 9495 - DNA, 539 bp, Artificial Sequence
  Synthetic polypeptide
gaagaggcaggcatggaggggcagcttggatggcaacttccagattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtag

SEQ ID NO: 9496 - DNA, 144 bp, Artificial Sequence
  Synthetic polypeptide
gaagaggcaggcatggaggggcagcttggatggcaacttccagattgccttgggtccccagtgtttactcccatcaaggcagacataagcggcaacatcacgatgaggaagctgagactcagaggggttgaaggactcgcttaa

SEQ ID NO: 9497 - DNA, 1585 bp, Artificial Sequence
  Synthetic polypeptide
cccccgcctggccagccgccccgtccgggaggtgaggggcgcctctgcctggccgcccctactgggaagtgaggagcccctctgccaggccagccgccccatccgggagggaggtgggggggtcagccccccgcccggccagccgccccgtccgggagggaggttggggggggtcagcccccaacccggccagccgccccgtccgggaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 9498 - DNA, 1562 bp, Artificial Sequence
  Synthetic polypeptide
ggccgggtgtgggggctcacacctgtaatcccagcactttgggaggctgaagcaggtggatcatctaaggtcaggagttggagaccagcctgaccaacatggtgaaaccccgtctctactaaaaatacaaaaatcatccaggcatccatgcctgtaatcccagctactccagaggctgaggcaggagaatcgctagaacccgcgaggcaggtgttgagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataa

SEQ ID NO: 9499 - DNA, 741 bp, Artificial Sequence
  Synthetic polypeptide
ggccgggtgtgggggctcacacctgtaatcccagcactttgggaggctgaagcaggtggatcatctaaggtcaggagttggagaccagcctgaccaacatggtgaaaccccgtctctactaaaaatacaaaaatcatccaggcatccatgcctgtaatcccagctactccagaggctgaggcaggagaatcgctagaacccgcgaggcaggtgttgagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagcccccc

SEQ ID NO: 9500 - DNA, 568 bp, Artificial Sequence
  Synthetic polypeptide
ggccgggtgtgggggctcacacctgtaatcccagcactttgggaggctgaagcaggtggatcatctaaggtcaggagttggagaccagcctgaccaacatggtgaaaccccgtctctactaaaaatacaaaaatcatccaggcatccatgcctgtaatcccagctactccagaggctgaggcaggagaatcgctagaacccgcgaggcaggtgttgagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagt

SEQ ID NO: 9501 - DNA, 973 bp, Artificial Sequence
  Synthetic polypeptide
tgtgctgggttagtaaagttaagcttggaactgttttccagaatccccttccttgtatggctctgagtaagatttggccaagaggaatttgcacaagattttagaaggcaggaacaatgcaacagacgtgactcaatgaagatttcaggattaggatagtgatggacactcacaaagccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctag

SEQ ID NO: 9502 - DNA, 976 bp, Artificial Sequence
  Synthetic polypeptide
tgtgctgggttagtaaagttaagcttggaactgttttccagaatccccttccttgtatggctctgagtaagatttggccaagaggaatttgcacaagattttagaaggcaggaacaatgcaacagacgtgactcaatgaagatttcaggattaggatagtgatggacactcacaaagccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacattacgtaatcaaggtcaagtgaggggaacaagcgcagccagtgatgagtga

SEQ ID NO: 9503 - DNA, 654 bp, Artificial Sequence
  Synthetic polypeptide
tgtgctgggttagtaaagttaagcttggaactgttttccagaatccccttccttgtatggctctgagtaagatttggccaagaggaatttgcacaagattttagaaggcaggaacaatgcaacagacgtgactcaatgaagatttcaggattaggatagtgatggacactcacaaagccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagt

SEQ ID NO: 9504 - DNA, 902 bp, Artificial Sequence; identical to SEQ ID NO: 7370
  Synthetic polypeptide

SEQ ID NO: 9505 - DNA, 455 bp, Artificial Sequence
  Synthetic polypeptide
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaa

SEQ ID NO: 9506 - DNA, 2017 bp, Artificial Sequence
  Synthetic polypeptide
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaa

SEQ ID NO: 9507 - DNA, 2032 bp, Artificial Sequence
  Synthetic polypeptide
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccaggccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaa

SEQ ID NO: 9508 - DNA, 2131 bp, Artificial Sequence
  Synthetic polypeptide
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagcagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaa

SEQ ID NO: 9509 - DNA, 142 bp, Artificial Sequence
  Synthetic polypeptide
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccgg

SEQ ID NO: 9510 - DNA, 2053 bp, Artificial Sequence; identical to SEQ ID NO: 7369
  Synthetic polypeptide

SEQ ID NO: 9511 - DNA, 167 bp, Artificial Sequence
  Synthetic polypeptide
cgacaccagcacatagtaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttag

SEQ ID NO: 9512 - DNA, 780 bp, Artificial Sequence
  Synthetic polypeptide
tccatctctttattcttgagacctggctgtcccctaagcactgcctgctcctgcagcccccagacgggggctccttcctttctccctgcccttgtgcagtagggtgtggaatgggttaagagtcctctttgtgtagttgttgatgcttctagactcctcttcttccttcctccctgaaacgccagctttgaagcccacaccatagactgtgcctgacaagcccttcactctgctatggtgccatcaccacatccagtgtctgctgagaaatcttcctctccgtcaacctgtgggcagtatttggcacctttgaagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctga

SEQ ID NO: 9513 - DNA, 606 bp, Artificial Sequence
  Synthetic polypeptide
tccatctctttattcttgagacctggctgtcccctaagcactgcctgctcctgcagcccccagacgggggctccttcctttctccctgcccttgtgcagtagggtgtggaatgggttaagagtcctctttgtgtagttgttgatgcttctagactcctcttcttccttcctccctgaaacgccagctttgaagcccacaccatagactgtgcctgacaagcccttcactctgctatggtgccatcaccacatccagtgtctgctgagaaatcttcctctccgtcaacctgtgggcagtatttggcacctttgaagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtga

SEQ ID NO: 9514 - DNA, 665 bp, Artificial Sequence; identical to SEQ ID NO: 6745
  Synthetic polypeptide

SEQ ID NO: 9515 - DNA, 1446 bp, Artificial Sequence; identical to SEQ ID NO: 8572
  Synthetic polypeptide

SEQ ID NO: 9516 - DNA, 104 bp, Artificial Sequence; identical to SEQ ID NO: 8573
  Synthetic polypeptide

SEQ ID NO: 9517 - DNA, 489 bp, Artificial Sequence; identical to SEQ ID NO: 8574
  Synthetic polypeptide

SEQ ID NO: 9518 - DNA, 1087 bp, Artificial Sequence
  Synthetic polypeptide
caagaactcaggaaacattttatgagttccagtcctggctctccctcttgatagctgcatgacaaagatgtccttgggtttcagtttcctcatctgtgaaatgaaaacatagtaggcctccctggatggagtttgtctgaggatttgaagatccagtgcagatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctag

SEQ ID NO: 9519 - DNA, 784 bp, Artificial Sequence; identical to SEQ ID NO: 6798
  Synthetic polypeptide

SEQ ID NO: 9520 - DNA, 1072 bp, Artificial Sequence
  Synthetic polypeptide
tgtcaggcctctgagcccaagccaagccatcacatcccctgtgacttgcacgtatacacccagatggcctgaagtaactggagaatcacaaaagaagtgaaaaggccctgccccgccttaactgatgacattccaccattgtgatttgttcctgccccaccttaactgagtgattaaccctgtgaatttccttgtcctggctcagagtctcccccactgagcaccttgtgacccccgcccctgcccaccagagaacaaccccctttgactgtaattttccatttcctttccaaatcctataaaacggccccacccctatctcccttcgctgactctctttttggactcagcccacctgcacccaggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactag

SEQ ID NO: 9521 - DNA, 586 bp, Artificial Sequence; identical to SEQ ID NO: 6809
  Synthetic polypeptide

SEQ ID NO: 9522 - DNA, 895 bp, Artificial Sequence; identical to SEQ ID NO: 613
  Synthetic polypeptide

SEQ ID NO: 9523 - DNA, 247 bp, Artificial Sequence; identical to SEQ ID NO: 614
  Synthetic polypeptide

SEQ ID NO: 9524 - DNA, 551 bp, Artificial Sequence; identical to SEQ ID NO: 615
  Synthetic polypeptide

SEQ ID NO: 9525 - DNA, 1257 bp, Artificial Sequence; identical to SEQ ID NO: 8602
  Synthetic polypeptide

SEQ ID NO: 9526 - DNA, 1072 bp, Artificial Sequence
  Synthetic polypeptide
tgtcaggcctctgagcccaagccaagccatcacatcccctgtgacttgcacgtatacacccagatggcctgaagtaactggagaatcacaaaagaagtgaaaaggccctgccccgccttaactgatgacattccaccattgtgatttgttcctgccccaccttaactgagtgattaaccctgtgaatttccttgtcctggctcagaggctcccccactgagcaccttgtgaccactgcccctgcccaccagagaacaaccccctttggctgtaattttccattacctttccaaatcctataaaacggccccacccctatctcccttcgctgactctctttttggactcagcccacctgcacccaggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactag

SEQ ID NO: 9527 - DNA, 2165 bp, Artificial Sequence
  Synthetic polypeptide
tctccctctttccacggtctccctctgaagctggactgtactgctgccatctcagctcactgcaacctccctgcctgattctcctgcctcagcctgccgagtgcctgcgattgcaggcgcgcgccgccacgcctgactggttttcctattttttgggtggagacggggtttcgctgtgttggccgggctggtctccagctcctaaccgcgagtgatccgccagcctcggcctcccgaggtgccgggattgcagacggagtctccttcactcagtgctcaatggtgcccaggctggagtgcagtggcgtgatctcggctccctacaacatccacctcccggcagcctgccttggcctcccaaagtgccgagattgcagcctctgcccagccgccaccccatctgggaaggccgccaccccgtctgggaagtgaggagcgtctctgcctggccgcccatcgtctgggatgtgaggagcccctctgcctggctgcccagtctggaaagtgaggagcatctctgcccagccgccatcccatctaggaagtgagaagcgcctcttcccggccgccatcccatctaggaagtgaggagcgtctctgcccggccacccatcgtctgagatgtggggagcgcctctgccctgtcgccccgtccgggatgtgaggagcgtctctgcctggccacctcgtctgagaagtgaggagaccctctgcctggcaaccgccctgtctgagaagtgaggagcccctccgcccagcagccgccccgtctgagaagttccgacacaaaaaggactgtccatgaatttattaatgaccagagagacaggtttctgctcgagtatgctttgtcaaccaaaagaaacacaatcaaaaagtttgaaaaagacatagcaatgagggaacggcaactaaaaaaagcagagaaaaagctccaagatgatgcactggcctttgaagagttccttcgagaaaatgaccagagatctgtagacgctctgaaaatggcagcacaggaaacaataaacaaactccaaatgacagcagagctgaagaaagcaagcatggaggtacaagcagtgaaaagtgaaatagcaaaaacagaattcctcctcagggagtatatgaaatatggtttttttctgctgcaaatgtctccaaaacattggcaaatccagcaagcactaaaaagagcacaggcatcaaaaagtaaagcaaatatcatccttccaaaaatattagcaaaattatcattacattcaagtaacaaggaaggcatccttgaggagtccgggaggacagctgtcctttcagaagatgcttctcagggaagagacagccaaggaaagccaagcagaagcctgactcgcactccagagaaaaagaaatcaaacctggctgaaagtttcggttcagaagacagtttggaattccttttagatgatgaaatggacgttgatttggagccagcactttatttcaaggaaccagaggagttacttcaagtcctcagagagctggaagagcagaatcttactttgtttcaatattcccaagatgtagatgaaaatcttgaagaggtaaacaaaagagaaaaagttatacaggataaaacaaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtaaaagtagaatctcgcctggtagaactgtgtgacctcatcgaatccattcccaaagaaaatgtggaggcaattgagaggatgaaacagaaagaatggcggcaaaagtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttga

SEQ ID NO: 9528 - DNA, 611 bp, Artificial Sequence
  Synthetic polypeptide
ggctagttgcaaccgaatcacccaggaacttcttaaaaatcagattcccaggcccacccccaagagattctaattcactatgcaaaagagacttcatcccagaaatctgtatcttcagttctccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaa

SEQ ID NO: 9529 - DNA, 578 bp, Artificial Sequence
  Synthetic polypeptide
ggctagttgcaaccgaatcacccaggaacttcttaaaaatcagattcccaggcccacccccaagagattctaattcactatgcaaaagagacttcatcccagaaatctgtatcttcagttctccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgc

SEQ ID NO: 9530 - DNA, 293 bp, Artificial Sequence
  Synthetic polypeptide
ggctagttgcaaccgaatcacccaggaacttcttaaaaatcagattcccaggcccacccccaagagattctaattcactatgcaaaagagacttcatcccagaaatctgtatcttcagttctccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattagataa

SEQ ID NO: 9531 - DNA, 1279 bp, Artificial Sequence; identical to SEQ ID NO: 795
  Synthetic polypeptide

SEQ ID NO: 9532 - DNA, 920 bp, Artificial Sequence
  Synthetic polypeptide
gggctccttagagaagtgattgattccagggctgggcagggaaaaaacaagatgagacaagagcattttgtgatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcatag

SEQ ID NO: 9533 - DNA, 493 bp, Artificial Sequence
  Synthetic polypeptide
ggcagcctggggtgggagtgtgagcacgggactcagaactggcttcagaccctgctctcttgctgtggccttgggaaagccaccatgcctctgtgacttttattcgttccatacaacgggggacctggatggtggtctctaaggccctgtcagtgggaacactgggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtga

SEQ ID NO: 9534 - DNA, 304 bp, Artificial Sequence
  Synthetic polypeptide
ggcagcctggggtgggagtgtgagcacgggactcagaactggcttcagaccctgctctcttgctgtggccttgggaaagccaccatgcctctgtgacttttattcgttccatacaacgggggacctggatggtggtctctaaggccctgtcagtgggaacactgggtacggctcctacctggtctggaaagagctgggaggcttcacagagaaggctgtggttcccctgggcctctacactgggcagctggccctgaactgggcatggccccccatcttctttggtgcccgacaaatgggctgg

SEQ ID NO: 9535 - DNA, 3238 bp, Artificial Sequence
  Synthetic polypeptide
taattaagatataatgtcggtgggctagcccgttgtcagaggataaaagtgtcctctcagtagataaatggtgacatttctggactattatcccacagcggagcctgtttcaatgactctatttctgctctgccaaatgattaatgatgtagattctgtccttctgcgtgtgacggctggagtcacaggagcgacagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaa

SEQ ID NO: 9536 - DNA, 3052 bp, Artificial Sequence; identical to SEQ ID NO: 7029
  Synthetic polypeptide

SEQ ID NO: 9537 - DNA, 3055 bp, Artificial Sequence; identical to SEQ ID NO: 7030
  Synthetic polypeptide

SEQ ID NO: 9538 - DNA, 575 bp, Artificial Sequence; identical to SEQ ID NO: 6581
  Synthetic polypeptide

SEQ ID NO: 9539 - DNA, 77 bp, Artificial Sequence
  Synthetic polypeptide
gccgacacccccactgctgctggagtagtagcttccactgctacacctcctcctcccggaagagcttcaagagctaa

SEQ ID NO: 9540 - DNA, 1211 bp, Artificial Sequence; identical to SEQ ID NO: 526
  Synthetic polypeptide

SEQ ID NO: 9541 - DNA, 1133 bp, Artificial Sequence; identical to SEQ ID NO: 527
  Synthetic polypeptide

SEQ ID NO: 9542 - DNA, 841 bp, Artificial Sequence; identical to SEQ ID NO: 529
  Synthetic polypeptide

SEQ ID NO: 9543 - DNA, 659 bp, Artificial Sequence; identical to SEQ ID NO: 530
  Synthetic polypeptide

SEQ ID NO: 9544 - DNA, 961 bp, Artificial Sequence; identical to SEQ ID NO: 6722
  Synthetic polypeptide

SEQ ID NO: 9545 - DNA, 265 bp, Artificial Sequence; identical to SEQ ID NO: 8378
  Synthetic polypeptide

SEQ ID NO: 9546 - DNA, 87 bp, Artificial Sequence
  Synthetic polypeptide
aagactgttttcatctaataacaccaagggcccactgatgatggtgaagaagagatggaagaagacacagtcacaaacgggtcctga

SEQ ID NO: 9547 - DNA, 66 bp, Artificial Sequence
  Synthetic polypeptide
aagactgttttcatctaataacaccaagggcccactgatgatggtgaagaagagatggaagaagac

SEQ ID NO: 9548 - DNA, 1407 bp, Artificial Sequence
  Synthetic polypeptide
cccccgcctggccagccgccccgtccgggaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 9549 - DNA, 689 bp, Artificial Sequence; identical to SEQ ID NO: 8698
  Synthetic polypeptide

SEQ ID NO: 9550 - DNA, 2196 bp, Artificial Sequence
  Synthetic polypeptide
tctccctctccctctccccatggtctccctctccctctccccacggtctccctctccctctctttccacggtctccctctcatgctgagccgaagctggactgtactgctgccatctcggctcactgcaacctccctgcctgattctcctgactcagcctgccgagtacctgcgattgcaggctggcgccgccacgcctgactggttttggtggagaccgggtttcgctatgttggccaggccggtctccaacccctaactgcaagtgatccgccagcctcggcctcccgaggtgcggggattgcagacggagtctcgttcactcagtgctcaatggtgcccaggctggagtgcagtggcgtgatctcggctcgctacaacctccacctcccagccgcctgccttggcctcccaaagtgccgagattgcagaaagattgcagcctctgcccggccaccaccccgtctgggaagtgaggagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggccgcccatcgtctgagatgtggggagcgcctctgccctgccgccccgtctgggatgtgaggagcacctctgcccggccgcgaccctgtctgggaggtgaggagcatctctgcctgccgccccctctgagaagtgaggagaccctctgcccggcaaccgccccgtctgagaagaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 9551 - DNA, 1974 bp, Artificial Sequence
  Synthetic polypeptide
gagaaattggaaccctcgtacattgctggtgggaatataaaatggtgcggccactttggaaaacagcttggtagttcctcaagaagggaaacatagagttacacatgacccagcaagtctactcctaagtatatacccaagacaatgaaacatgtctacacaaaaacttgtgtataagtgatcatagcagcactattcataattgacaaaaagtagaaacaacccaaatgtccatcagccgaggagtggataagccaaatgtggtggatcgagacaatggaatattatttggcaataaaaaggaatgaacacttaaacatgcttatataacatggatgcacctggaaaacctcccactaagagaaagaagcaggcacaaaaggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctga

SEQ ID NO: 9552 - DNA, 829 bp, Artificial Sequence; identical to SEQ ID NO: 6626
  Synthetic polypeptide

SEQ ID NO: 9553 - DNA, 484 bp, Artificial Sequence; identical to SEQ ID NO: 6627
  Synthetic polypeptide

SEQ ID NO: 9554 - DNA, 4048 bp, Artificial Sequence
  Synthetic polypeptide
atatattttgtaaggctatggatgccataaatagtgatttatcagatggatttggtcaaagtaaattgaaagccttctggaaaggactaaccattctagatgccattgagaacatttgtgattcatgagaggaggtcagagtagcaacattaacaggagtttggaagaagttgattccaaccttcgtggatgacttaagttcaagacttcagcggaggaattagctgcaggtatggtggaaatagcaggagtacaagaattagaagtagagcctgacagtgtgactgaattgctgcagttttatgattaaaccttaatgcatgaggatttgcttcttacggataagcaaagtaagtggcttcttgagatggcatccactcctggtgatgatgctgtgaacactgttgaaattgacaacaaaggatttagaatattacataaacttacttaataaagcagctacagggtttgagaagattgactccaattttgaaagaacttctcttgtggataaaacactgtcaaacagcattgaatgctacagagaaatctttcataaaaggaagtcagtcgaggcagcagaattcattgttgtcttgttttaagaaattgccgtagccacccaaaccttcaacaaacagccatcagcatcaaggcaagaccctccaccaacaaagagattacagttcactcaaggctcaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtga

SEQ ID NO: 9555 - DNA, 1160 bp, Artificial Sequence
  Synthetic polypeptide
aggagaacgagcacagggcttggtttcagatggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctag

SEQ ID NO: 9556 - DNA, 48 bp, Artificial Sequence
  Synthetic polypeptide
aggagaacgagcacagggcttggtttcagatggtggatgggcaggtgg

SEQ ID NO: 9557 - DNA, 222 bp, Artificial Sequence
  Synthetic polypeptide
cagagacaaattctctttgacctttgtattcccgggtgtgggtgatgtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtga

SEQ ID NO: 9558 - DNA, 308 bp, Artificial Sequence; identical to SEQ ID NO: 6645
  Synthetic polypeptide

SEQ ID NO: 9559 - DNA, 281 bp, Artificial Sequence; identical to SEQ ID NO: 6646
  Synthetic polypeptide

SEQ ID NO: 9560 - DNA, 359 bp, Artificial Sequence; identical to SEQ ID NO: 6647
  Synthetic polypeptide

SEQ ID NO: 9561 - DNA, 230 bp, Artificial Sequence; identical to SEQ ID NO: 6648
  Synthetic polypeptide

SEQ ID NO: 9562 - DNA, 2232 bp, Artificial Sequence
  Synthetic polypeptide
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaa

SEQ ID NO: 9563 - DNA, 834 bp, Artificial Sequence
  Synthetic polypeptide
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataag

SEQ ID NO: 9564 - DNA, 847 bp, Artificial Sequence
  Synthetic polypeptide
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactca

SEQ ID NO: 9565 - DNA, 588 bp, Artificial Sequence; identical to SEQ ID NO: 7495
  Synthetic polypeptide

SEQ ID NO: 9566 - DNA, 164 bp, Artificial Sequence; identical to SEQ ID NO: 831
  Synthetic polypeptide

SEQ ID NO: 9567 - DNA, 193 bp, Artificial Sequence; identical to SEQ ID NO: 834
  Synthetic polypeptide

SEQ ID NO: 9568 - DNA, 1083 bp, Artificial Sequence; identical to SEQ ID NO: 7080
  Synthetic polypeptide

SEQ ID NO: 9569 - DNA, 594 bp, Artificial Sequence
  Synthetic polypeptide
gagggaggagccaagatggccgaataggaacagctccggtctacagctcccagcatgagcaacgcagaagacgggtgatttctgcatttccatctgagattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattag

SEQ ID NO: 9570 - DNA, 236 bp, Artificial Sequence
  Synthetic polypeptide
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctgatctcatagagtctggccagcttcgagaaagagttgagaagttaaacatgctcagcattgatcatctcacagaccacaagtcacagcgcctt

SEQ ID NO: 9571 - DNA, 542 bp, Artificial Sequence
  Synthetic polypeptide
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagta

SEQ ID NO: 9572 - DNA, 1214 bp, Artificial Sequence
  Synthetic polypeptide
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaa

SEQ ID NO: 9573 - DNA, 144 bp, Artificial Sequence
  Synthetic polypeptide
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctg

SEQ ID NO: 9574 - DNA, 515 bp, Artificial Sequence
  Synthetic polypeptide
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagtatgtaaacagaacatggacgttttgttctcatttcgtgatggagactgcagtaaaggattcttcctggtctctctattggtggaaatag

SEQ ID NO: 9575 - DNA, 948 bp, Artificial Sequence
  Synthetic polypeptide
ctcttgatctttatcccactcttcctttaatcctctctttcaggaaatgcaaatgcgtagggggaaaccctaaggaatcatcctccagtcttcatcttcctgcacctgttgatctgcaagacctgttggttctgcctccacagcgcatatccacttccatcatttttgctgtcaccctggcccaagccgacgttgtctcgagtcaactaccgaaatagtttcctagctgatctctctgcttttcttctggctcccctaaaattcagtctccgtactctggccaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatga

SEQ ID NO: 9576 - DNA, 966 bp, Artificial Sequence
  Synthetic polypeptide
tcagtcctctgtatcgggggtccacgccgtggatccagccaaccgtaggttggaaatgttcagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaa

SEQ ID NO: 9577 - DNA, 576 bp, Artificial Sequence
  Synthetic polypeptide
ggccgggtgcagtggctcacaactgtaatcccaggactttgggaggctgaggcgggcagatcacctgaggtcaggagtttgagagcagcctggtcaacatgatgaaatcccgtctctactaaaaatacaaaaaattagctggacatggtggcagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaa

SEQ ID NO: 9578 - DNA, 570 bp, Artificial Sequence
  Synthetic polypeptide
ggccgggtgcagtggctcacaactgtaatcccaggactttgggaggctgaggcgggcagatcacctgaggtcaggagtttgagagcagcctggtcaacatgatgaaatcccgtctctactaaaaatacaaaaaattagctggacatggtggcagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggccctaa

SEQ ID NO: 9579 - DNA, 573 bp, Artificial Sequence
  Synthetic polypeptide
ggccgggtgcagtggctcacaactgtaatcccaggactttgggaggctgaggcgggcagatcacctgaggtcaggagtttgagagcagcctggtcaacatgatgaaatcccgtctctactaaaaatacaaaaaattagctggacatggtggcagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgtaa

SEQ ID NO: 9580 - DNA, 375 bp, Artificial Sequence; identical to SEQ ID NO: 860
  Synthetic polypeptide

SEQ ID NO: 9581 - DNA, 255 bp, Artificial Sequence; identical to SEQ ID NO: 862
  Synthetic polypeptide

SEQ ID NO: 9582 - DNA, 994 bp, Artificial Sequence
  Synthetic polypeptide
ctctccctctccctctccctctccccatggtctccctctccccatggtctccctctccctctctttccacggtctccctctcatgccgagccgaagctggactatactgctgccatctcggctcactgcaacctccctgcctgattctcctgcctcagcctgccgagtgcctgcgattgcaggcgcgcgcctccacgcctgactggttttcgtatttttttggtggagacggggtttcgctgtgttggccgggctggtctccagctcctaaccgcgagtgatccgccagcctcggcctcccgaggtgccgggattgcagacggagtctggttcactcagtgctcaatggcgcccaggctggagtgcagtggcgtgatctcggctcgctacaacctccacctcccagccgcctgccttggcctcccgaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcctggccgccatcccatctgggaagtgaggagcgcctcttcccggccgccatcacatctaggaagtgaggagcgtctctgcccggccgcccatcgtctgggatgtggggagtgcctctgccccgccgccctgtctgggatgtgaggagcgcctctgcccggccgccaccccgtctgggaggatgggcacgatctcggctcactgcaacctccgcctcccgggttcaagcaattctcctgtctcagcctcccctcagtgcacttttataaaccgtcctcagaacccttgggaagcccaagatcgtcaaaaagagaaccaagaagtttatccggcaccagtctgaccgatatgtcaaaattaagcgtaaccggcggaaacccagaggtattgacaacagggttcgtggaaggttcaagggttagatcttga

SEQ ID NO: 9583 - DNA, 582 bp, Artificial Sequence
  Synthetic polypeptide
cccccgcccggccagccgccctgtccgggagggaggtgggggggtcagccctccgctgggccagccgccccgtctgggaggtgaggggcgcctctgcccggccgcccctactgggaagtgaggagcccctctgcccggccagccgccccgtccgggagggaggtgggggggtcagccccccgcccggccagccgccccgtccgggagggaggtggggggggtcagccccctgcccggccggcctccccgtccgggaggtgaggggcgcctctgcccggccgcccctactgggaagtgaggagcccctctgcccggccagccgccccgtccgggagggaggttggggggtcagccccccgcccggccagccgccccgtccgggagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaag

SEQ ID NO: 9584 - DNA, 711 bp, Artificial Sequence; identical to SEQ ID NO: 7377
  Synthetic polypeptide

SEQ ID NO: 9585 - DNA, 1234 bp, Artificial Sequence; identical to SEQ ID NO: 676
  Synthetic polypeptide

SEQ ID NO: 9586 - DNA, 586 bp, Artificial Sequence; identical to SEQ ID NO: 677
  Synthetic polypeptide

SEQ ID NO: 9587 - DNA, 890 bp, Artificial Sequence; identical to SEQ ID NO: 678
  Synthetic polypeptide

SEQ ID NO: 9588 - DNA, 1516 bp, Artificial Sequence; identical to SEQ ID NO: 534
  Synthetic polypeptide

SEQ ID NO: 9589 - DNA, 591 bp, Artificial Sequence; identical to SEQ ID NO: 539
  Synthetic polypeptide

SEQ ID NO: 9590 - DNA, 482 bp, Artificial Sequence; identical to SEQ ID NO: 540
  Synthetic polypeptide

SEQ ID NO: 9591 - DNA, 444 bp, Artificial Sequence; identical to SEQ ID NO: 541
  Synthetic polypeptide

SEQ ID NO: 9592 - DNA, 334 bp, Artificial Sequence; identical to SEQ ID NO: 533
  Synthetic polypeptide

SEQ ID NO: 9593 - DNA, 38 bp, Artificial Sequence; identical to SEQ ID NO: 543
  Synthetic polypeptide

SEQ ID NO: 9594 - DNA, 245 bp, Artificial Sequence; identical to SEQ ID NO: 542
  Synthetic polypeptide

SEQ ID NO: 9595 - DNA, 898 bp, Artificial Sequence; identical to SEQ ID NO: 569
  Synthetic polypeptide

SEQ ID NO: 9596 - DNA, 961 bp, Artificial Sequence; identical to SEQ ID NO: 570
  Synthetic polypeptide

SEQ ID NO: 9597 - DNA, 818 bp, Artificial Sequence; identical to SEQ ID NO: 572
  Synthetic polypeptide

SEQ ID NO: 9598 - DNA, 974 bp, Artificial Sequence
  Synthetic polypeptide
ctctcccctctcccttctcccctctcccctctccctctcggtctccctctccctctctttccactgtctccctctgatgccgagccgaagctggactgtactgctgccatctcggctcactgcaacctccccgcctgattctcctgcctcagcctgcccagtgcctgcgattgcaggcgcgcgccaccacgcctgactggttttcgtacttttttggtggagatggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggaggtgaggagcgtctctgcccagccgccccgtctgagaagtgaggagcccctccgcccggcagctgccccgtctgagaaggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 9599 - DNA, 1039 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctag

SEQ ID NO: 9600 - DNA, 248 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctga

SEQ ID NO: 9601 - DNA, 505 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagcctttcgattaccaggcattggtattagatactgtgatgtgtgcagttacttcttgcagtccttcccttgaccttgtggccttgaagttcctggcactcccagttccagattag

SEQ ID NO: 9602 - DNA, 383 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccg

SEQ ID NO: 9603 - DNA, 352 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaac

SEQ ID NO: 9604 - DNA, 349 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtg

SEQ ID NO: 9605 - DNA, 328 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 9606 - DNA, 291 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcct

SEQ ID NO: 9607 - DNA, 254 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagca

SEQ ID NO: 9608 - DNA, 193 bp, Artificial Sequence
  Synthetic polypeptide
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccc

SEQ ID NO: 9609 - DNA, 779 bp, Artificial Sequence
  Synthetic polypeptide
cagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagccgccccgtctgagaagtgaggagcctctccacccggcagccaccccatctgggaagtgaggagcgtctccgcccggcagccaccccgtccgggagggaggtggggggggtcagccccccgcccggccagccgccccgtccgggagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaag

SEQ ID NO: 9610 - DNA, 3999 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagtgaggagcccctccgcctggcagctgccctgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtga

SEQ ID NO: 9611 - DNA, 4128 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagtgaggagcccctccgcctggcagctgccctgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtga

SEQ ID NO: 9612 - DNA, 1177 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagtgaggagcccctccgcctggcagctgccctgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 9613 - DNA, 370 bp, Artificial Sequence; identical to SEQ ID NO: 6522
  Synthetic polypeptide

SEQ ID NO: 9614 - DNA, 1114 bp, Artificial Sequence
  Synthetic polypeptide
tactagctaagtgaacttaaacatatttcccagtctcttcacatctcaacttcttcatctgcaaagaggagataaataaatgcatcgcacaggttatggtgaaaaatcaagataatgtagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaa

SEQ ID NO: 9615 - DNA, 3919 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtga

SEQ ID NO: 9616 - DNA, 4048 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtga

SEQ ID NO: 9617 - DNA, 1097 bp, Artificial Sequence
  Synthetic polypeptide
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 9618 - DNA, 1453 bp, Artificial Sequence; identical to SEQ ID NO: 8375
  Synthetic polypeptide

SEQ ID NO: 9619 - DNA, 720 bp, Artificial Sequence; identical to SEQ ID NO: 7789
  Synthetic polypeptide

SEQ ID NO: 9620 - DNA, 731 bp, Artificial Sequence
  Synthetic polypeptide
cagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 9621 - DNA, 451 bp, Artificial Sequence; identical to SEQ ID NO: 837
  Synthetic polypeptide

SEQ ID NO: 9622 - DNA, 3744 bp, Artificial Sequence; identical to SEQ ID NO: 8524
  Synthetic polypeptide

SEQ ID NO: 9623 - DNA, 864 bp, Artificial Sequence; identical to SEQ ID NO: 6975
  Synthetic polypeptide

SEQ ID NO: 9624 - DNA, 471 bp, Artificial Sequence; identical to SEQ ID NO: 6976
  Synthetic polypeptide

SEQ ID NO: 9625 - DNA, 367 bp, Artificial Sequence; identical to SEQ ID NO: 548
  Synthetic polypeptide

SEQ ID NO: 9626 - DNA, 1157 bp, Artificial Sequence
  Synthetic polypeptide
ctctccctctccctctccgtctccgtctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcccgcgccgccacgcctgattggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatagtctgagacgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 9627 - DNA, 763 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactgcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtag

SEQ ID NO: 9628 - DNA, 2264 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactgcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 9629 - DNA, 761 bp, Artificial Sequence; identical to SEQ ID NO: 7260
  Synthetic polypeptide

SEQ ID NO: 9630 - DNA, 675 bp, Artificial Sequence; identical to SEQ ID NO: 7261
  Synthetic polypeptide

SEQ ID NO: 9631 - DNA, 883 bp, Artificial Sequence
  Synthetic polypeptide
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatcctttttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 9632 - DNA, 3347 bp, Artificial Sequence
  Synthetic polypeptide
aggcggtcatgtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtga

SEQ ID NO: 9633 - DNA, 392 bp, Artificial Sequence
  Synthetic polypeptide
aggcggtcatgtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaag

SEQ ID NO: 9634 - DNA, 3140 bp, Artificial Sequence
  Synthetic polypeptide
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtaagcggcctctttttacactcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacagactgggaaggcagccttcccttggtgtttaatcaatgcagggaagcctctctgattattcacccatgtttcaagggtgtcagaccacgcagggatgcctgccttggtccttcacccttagcggcaagacctgcttttctggggaaggggcaagtactccaaccccttctctccttgtctctaccccttctctgcttttctggggaaagggcaagtaccccaaccccttctctccttgtctctaccccttctctgcttttctggggaaagggcaagtaccccaaccccttctctccttgtctctaccccttctctgcttttctgggggaggagcaagtacccctcaaccccttctccttcacccttagcagcaagtcccacttttctagggggcaagaacccccaattccttatttccacaccccgacctcttatctctgtgccccaatcccttatttcctcacccctacctcttatctctgtgccccaatcctttatttccacaccccgacctcttatctctgtgccccaatcccttatttccgcaccccatcctcttatctctgtgccccaatcccttatttccatgccccgaccccccttcccgcttttctggagggtaagaacccccgaaccccttccctccgtgtctctatgctctcttttctctaggtttgcctccttcactatgggcaaccttccaccctccattcctcctccttctccctcagcctgtgttctcaagaacttaaaacctcttcaactcacacctgacctaaaacccaaatgccttattttcttctgcaatgctgcttgaccccaatacaaactagacagtagttccaaatagccagaaaacggcactttcaatttttccatcctacaagatctaaatatttcttgttgtaaaatgagcaaatggtctgaggtgcctgacgtccaggcattcttttacacatcagtcccttcctagtctctgtgcccagtgcaactcgtcccaaatcttccttctttccctcccgcctgtcgcctcagtcccaaccccaagcgttgctgagtctttctaatcttccttttctacagacctatctgacctctcccctcctcgccaggccaagctaggtcccaattcttcctcagcctctgctcctccaccctataatctttttattgcctcccctcctcacacctggtccggcttacagtttcgttcggtgactagccctcccccacctgcccagcaatttactcttaaaaaggtggctggagccaaaggcatagtcaaggttaatgctcctttttgtttatcccaaatcagatagtgtttaggctctttttcatcaaatataaaaacccagcccagttcatgactcgtttggcagcaaccctgagatgctttacagccctagaccctaaaaggtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacttccaaatgcctgaaccgcagcggccaggcgttcctccagaacctcctcccccaggagcttgctacaagtgccagaaatctgaccaccaggccaaggaatgcctgcagcccaggatttctcctaagccacgtcccatctctgcgggaccccactagaaatcggactgttcaactcacctggcagccactcccatagcttctggaactctggcccaaggctctctgactccttcccagatcttcttggcttagcggctgaagactgatgctgcctaattgcctcggaaacaccgtagaccatcacggacgccgagcttcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaa

SEQ ID NO: 9635 - DNA, 3209 bp, Artificial Sequence
  Synthetic polypeptide
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtaagcggcctctttttacactcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacagactgggaaggcagccttcccttggtgtttaatcaatgcagggaagcctctctgattattcacccatgtttcaagggtgtcagaccacgcagggatgcctgccttggtccttcacccttagcggcaagacctgcttttctggggaaggggcaagtactccaaccccttctctccttgtctctaccccttctctgcttttctggggaaagggcaagtaccccaaccccttctctccttgtctctaccccttctctgcttttctggggaaagggcaagtaccccaaccccttctctccttgtctctaccccttctctgcttttctgggggaggagcaagtacccctcaaccccttctccttcacccttagcagcaagtcccacttttctagggggcaagaacccccaattccttatttccacaccccgacctcttatctctgtgccccaatcccttatttcctcacccctacctcttatctctgtgccccaatcctttatttccacaccccgacctcttatctctgtgccccaatcccttatttccgcaccccatcctcttatctctgtgccccaatcccttatttccatgccccgaccccccttcccgcttttctggagggtaagaacccccgaaccccttccctccgtgtctctatgctctcttttctctaggtttgcctccttcactatgggcaaccttccaccctccattcctcctccttctccctcagcctgtgttctcaagaacttaaaacctcttcaactcacacctgacctaaaacccaaatgccttattttcttctgcaatgctgcttgaccccaatacaaactagacagtagttccaaatagccagaaaacggcactttcaatttttccatcctacaagatctaaatatttcttgttgtaaaatgagcaaatggtctgaggtgcctgacgtccaggcattcttttacacatcagtcccttcctagtctctgtgcccagtgcaactcgtcccaaatcttccttctttccctcccgcctgtcgcctcagtcccaaccccaagcgttgctgagtctttctaatcttccttttctacagacctatctgacctctcccctcctcgccaggccaagctaggtcccaattcttcctcagcctctgctcctccaccctataatctttttattgcctcccctcctcacacctggtccggcttacagtttcgttcggtgactagccctcccccacctgcccagcaatttactcttaaaaaggtggctggagccaaaggcatagtcaaggttaatgctcctttttgtttatcccaaatcagatagtgtttaggctctttttcatcaaatataaaaacccagcccagttcatgactcgtttggcagcaaccctgagatgctttacagccctagaccctaaaaggtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacttccaaatgcctgaaccgcagcggccaggcgttcctccagaacctcctcccccaggagcttgctacaagtgccagaaatctgaccaccaggccaaggaatgcctgcagcccaggatttctcctaagccacgtcccatctctgcgggaccccactagaaatcggactgttcaactcacctggcagccactcccatagcttctggaactctggcccaaggctctctgactccttcccagatcttcttggcttagcggctgaagactgatgctgcctaattgcctcggaaacaccgtagaccatcacggacgccgagcttcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaagaaattggtaccaccgtgcacttcaagcaaaaaggacctgggtcggtgagaggaataaatggatccatcagtctggccgtaccactgtggctgctggcagcatctctgctctgccttctcagcaaatgttaa

SEQ ID NO: 9636 - DNA, 2637 bp, Artificial Sequence
  Synthetic polypeptide
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtaagcggcctctttttacactcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacagactgggaaggcagccttcccttggtgtttaatcaatgcagggaagcctctctgattattcacccatgtttcaagggtgtcagaccacgcagggatgcctgccttggtccttcacccttagcggcaagacctgcttttctggggaaggggcaagtactccaaccccttctctccttgtctctaccccttctctgcttttctggggaaagggcaagtaccccaaccccttctctccttgtctctaccccttctctgcttttctggggaaagggcaagtaccccaaccccttctctccttgtctctaccccttctctgcttttctgggggaggagcaagtacccctcaaccccttctccttcacccttagcagcaagtcccacttttctagggggcaagaacccccaattccttatttccacaccccgacctcttatctctgtgccccaatcccttatttcctcacccctacctcttatctctgtgccccaatcctttatttccacaccccgacctcttatctctgtgccccaatcccttatttccgcaccccatcctcttatctctgtgccccaatcccttatttccatgccccgaccccccttcccgcttttctggagggtaagaacccccgaaccccttccctccgtgtctctatgctctcttttctctaggtttgcctccttcactatgggcaaccttccaccctccattcctcctccttctccctcagcctgtgttctcaagaacttaaaacctcttcaactcacacctgacctaaaacccaaatgccttattttcttctgcaatgctgcttgaccccaatacaaactagacagtagttccaaatagccagaaaacggcactttcaatttttccatcctacaagatctaaatatttcttgttgtaaaatgagcaaatggtctgaggtgcctgacgtccaggcattcttttacacatcagtcccttcctagtctctgtgcccagtgcaactcgtcccaaatcttccttctttccctcccgcctgtcgcctcagtcccaaccccaagcgttgctgagtctttctaatcttccttttctacagacctatctgacctctcccctcctcgccaggccaagctaggtcccaattcttcctcagcctctgctcctccaccctataatctttttattgcctcccctcctcacacctggtccggcttacagtttcgttcggtgactagccctcccccacctgcccagcaatttactcttaaaaaggtggctggagccaaaggcatagtcaaggttaatgctcctttttgtttatcccaaatcagatagtgtttaggctctttttcatcaaatataaaaacccagcccagttcatgactcgtttggcagcaaccctgagatgctttacagccctagaccctaaaaggtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacttccaaatgcctgaaccgcagcggccaggcgttcctccagaacctcctcccccaggagcttgctacaagtgccagaaatctgaccaccaggccaaggaatgcctgcagcccaggatttctcctaagccacgtcccatctctgcgggaccccactagaaatcggactgttcaactcacctggcagccactcccatagcttctggaactctggcccaaggctctctgactccttcccagatcttcttggcttagcggctgaagactgatgctgcctaattgcctcggaaacaccgtagaccatcacggacgccgagcttcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactg

SEQ ID NO: 9637 - DNA, 952 bp, Artificial Sequence; identical to SEQ ID NO: 8583
  Synthetic polypeptide

SEQ ID NO: 9638 - DNA, 87 bp, Artificial Sequence; identical to SEQ ID NO: 8584
  Synthetic polypeptide

SEQ ID NO: 9639 - DNA, 2513 bp, Artificial Sequence
  Synthetic polypeptide
ggatcctgatgcttatcaaatccaggctccttccttgaatgtgtgacctttggccagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattag

SEQ ID NO: 9640 - DNA, 1181 bp, Artificial Sequence
  Synthetic polypeptide
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactga

SEQ ID NO: 9641 - DNA, 1061 bp, Artificial Sequence
  Synthetic polypeptide
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggaggttggcgagctagcaaaacttggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactga

SEQ ID NO: 9642 - DNA, 851 bp, Artificial Sequence
  Synthetic polypeptide
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggagaaaaacctcaaagttccttctggtcagaatgcagatgtgcaaaagacagacaactga

SEQ ID NO: 9643 - DNA, 818 bp, Artificial Sequence
  Synthetic polypeptide
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggagcctatttcaatgatattgctgtag

SEQ ID NO: 9644 - DNA, 847 bp, Artificial Sequence
  Synthetic polypeptide
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggaggttggcgagctagcaaaacttggtgcagtatgctgtagggtggatcattcaca

SEQ ID NO: 9645 - DNA, 785 bp, Artificial Sequence; identical to SEQ ID NO: 6642
  Synthetic polypeptide

SEQ ID NO: 9646 - DNA, 440 bp, Artificial Sequence; identical to SEQ ID NO: 6643
  Synthetic polypeptide

SEQ ID NO: 9647 - DNA, 312 bp, Artificial Sequence
  Synthetic polypeptide
gaagagaggagggaataagacatagccagagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctga

SEQ ID NO: 9648 - DNA, 557 bp, Artificial Sequence; identical to SEQ ID NO: 7108
  Synthetic polypeptide

SEQ ID NO: 9649 - DNA, 599 bp, Artificial Sequence
  Synthetic polypeptide
gttctcaaaatatggttaagggacccctgaggattaccaagatcctttcatgaagtttttgagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaa

SEQ ID NO: 9650 - DNA, 686 bp, Artificial Sequence
  Synthetic polypeptide
gttctcaaaatatggttaagggacccctgaggattaccaagatcctttcatgaagtttttgagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaa

SEQ ID NO: 9651 - DNA, 375 bp, Artificial Sequence
  Synthetic polypeptide
cttccaggaagagtcccatgcctattccacagctgggagccctccccagggtgcctctcttccccctgcccaccgtctgcggtgaaggccctggtcaatttcaactcgactgagttttatttattcactctcctctccccctggactgtgagccacccggggcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctga

SEQ ID NO: 9652 - DNA, 618 bp, Artificial Sequence
  Synthetic polypeptide
cccccgcccggccagccgccccgtccgggagggaggtgggggggtcagccccccgcccggccagccaccccgtccggggggtgaggggcgcctctgcccggccgcccctactgggaagtgaggaacccctctgcccggccagccgccccgtccgggagggaggtgggggggtcagccccccgcccggccagccgccttgtccaggagggaggtgggggggtcagccccccgcccggccagccgccccgtccgggaggtgaggggcacctctgcccggccgcccctactaggaagtgaggcgccccgctgcccggccagccgctccgtccgggagggaggtgggggggtcagccccctgcccgtccagccgccccgtccgggaggtgaggggcgcctctgcccggccgcccctactgggaagtgaggagcccctctgcccggccaccaccccgtctgggagggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 9653 - DNA, 659 bp, Artificial Sequence
  Synthetic polypeptide
tgtggaggaaggatcatggagtttggaattaaagcccagttgtactacttcccagctatgtaagcttggctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaa

SEQ ID NO: 9654 - DNA, 852 bp, Artificial Sequence
  Synthetic polypeptide
ctggagagaaagaaccatgggtgggaaaaggtcctggagatctgaaatgaagacccggttctgccatagacttgctgtgtgatcttggccaaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagggtgccagacataggacctcaaaaacctctggtgcccaatgccctccgatgacttcagcaacctgcctgctggctgcacgtgtggctcttctctccgcagcgctggtgcgcgaagccaccgggcgcacagcccagcgctgtcgtctgagtccgcgggcggccgccgagcgcctgctggggccgccacctcacgttgcagcaggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctga

SEQ ID NO: 9655 - DNA, 663 bp, Artificial Sequence
  Synthetic polypeptide
ctggagagaaagaaccatgggtgggaaaaggtcctggagatctgaaatgaagacccggttctgccatagacttgctgtgtgatcttggccaaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtga

SEQ ID NO: 9656 - DNA, 218 bp, Artificial Sequence
  Synthetic polypeptide
ctggagagaaagaaccatgggtgggaaaaggtcctggagatctgaaatgaagacccggttctgccatagacttgctgtgtgatcttggccaaggatatcacctaccttcgcatcccggtcgctgatacccctgaggtacccatcaaaaagcacttcaaagaatgtatcaacttcatccactgctgccgccttaatggggggaactgccttgtgcactg

SEQ ID NO: 9657 - DNA, 1211 bp, Artificial Sequence
  Synthetic polypeptide
tgtactagatttgttagtcattgcctaccaaacccagccacttctgagcaaccatactccatccacagcccaattgctgaaactgcaaatggaatggtagcattctgcacggtgggatctttcttctccaggcaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaa

SEQ ID NO: 9658 - DNA, 1127 bp, Artificial Sequence
  Synthetic polypeptide
tgtactagatttgttagtcattgcctaccaaacccagccacttctgagcaaccatactccatccacagcccaattgctgaaactgcaaatggaatggtagcattctgcacggtgggatctttcttctccaggcaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaa

SEQ ID NO: 9659 - DNA, 866 bp, Artificial Sequence
  Synthetic polypeptide
ggccaggtgcagtggctcacgcctgtaatcccagcactttgggaggccgaggtgggcggatcacctgaggtcaggggttcaagatcagcctgaccaacatgaagaaaccccatctctacaaaaaatacaaaattagccaggtgtggtggcgcatgcctgtaatcccagccacgctactcgggaggctgaggaaggagaatcgcttgaacccaggaggcagaggttacgttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtag

SEQ ID NO: 9660 - DNA, 888 bp, Artificial Sequence
  Synthetic polypeptide
gccgggcgcagtggctcacgcctgtaatcctagcactttgggaggccgaggcaggcagatcacaaggtcaagagatcgagaccatcctggccaacatggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtag

SEQ ID NO: 9661 - DNA, 1254 bp, Artificial Sequence
  Synthetic polypeptide
gccgggcgcagtggctcacgcctgtaatcctagcactttgggaggccgaggcaggcagatcacaaggtcaagagatcgagaccatcctggccaacatggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 9662 - DNA, 1104 bp, Artificial Sequence
  Synthetic polypeptide
gccgggcgcagtggctcacgcctgtaatcctagcactttgggaggccgaggcaggcagatcacaaggtcaagagatcgagaccatcctggccaacatggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 9663 - DNA, 1077 bp, Artificial Sequence
  Synthetic polypeptide
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaaggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctgggcccatccttgaatcaaaattcaaagtccaagacacatgtggagtccacaacctccatgggatgccgggggtcctgggggccctcctgggggtccttgtggctggacttgccacccatgaagcttacggagatgggtgagtttcctcccaacccgtactgcagtcgtcatccatctggaatgacctctgtcattctctttcactgtgtgtga

SEQ ID NO: 9664 - DNA, 684 bp, Artificial Sequence
  Synthetic polypeptide
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctga

SEQ ID NO: 9665 - DNA, 1764 bp, Artificial Sequence
  Synthetic polypeptide
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggaccccccagactcccagcactacgaggaccaagttcactggcaggtgcctggcgagcatgaggataaagcccagagacctctgagggtggaggaggcagacactcaggcctaa

SEQ ID NO: 9666 - DNA, 1716 bp, Artificial Sequence
  Synthetic polypeptide
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactccccccccagactcccagcactacgaggaccaagttcactggcaggtgcctggcgagcatga

SEQ ID NO: 9667 - DNA, 852 bp, Artificial Sequence
  Synthetic polypeptide
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaaaagagtctcactctgttgcccaggctggagtgcaacggcgcaatctcggctcactgcaaccttcacctcccaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctga

SEQ ID NO: 9668 - DNA, 1828 bp, Artificial Sequence; identical to SEQ ID NO: 6812
  Synthetic polypeptide

SEQ ID NO: 9669 - DNA, 1926 bp, Artificial Sequence
  Synthetic polypeptide
tggtaaccatggagggattctgagttgaggtacccctgacctttgacagatctattggtgcttggtagcaccatgagctaaccttatggctcaaaccaacaggacaatttgctgaggtctgggagcaccccctccatagagtccctgatctctcaaaacttggtcgtgatctaaagtttatttgatgtacaactccccctctccttcttttggagttttatttgcttccaagaaggaaggcaagatttcctgggtccgtgatgatggaaggctgacaactcttttatggagtttgagcttgctcccagcagggaagacaagttcgagtttttttcctgcttcaaggatggtagagagcagtcttcagcctgagacccatccctaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaa

SEQ ID NO: 9670 - DNA, 2439 bp, Artificial Sequence
  Synthetic polypeptide
tggtaaccatggagggattctgagttgaggtacccctgacctttgacagatctattggtgcttggtagcaccatgagctaaccttatggctcaaaccaacaggacaatttgctgaggtctgggagcaccccctccatagagtccctgatctctcaaaacttggtcgtgatctaaagtttatttgatgtacaactccccctctccttcttttggagttttatttgcttccaagaaggaaggcaagatttcctgggtccgtgatgatggaaggctgacaactcttttatggagtttgagcttgctcccagcagggaagacaagttcgagtttttttcctgcttcaaggatggtagagagcagtcttcagcctgagacccatccctaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaa

SEQ ID NO: 9671 - DNA, 2481 bp, Artificial Sequence
  Synthetic polypeptide
tggtaaccatggagggattctgagttgaggtacccctgacctttgacagatctattggtgcttggtagcaccatgagctaaccttatggctcaaaccaacaggacaatttgctgaggtctgggagcaccccctccatagagtccctgatctctcaaaacttggtcgtgatctaaagtttatttgatgtacaactccccctctccttcttttggagttttatttgcttccaagaaggaaggcaagatttcctgggtccgtgatgatggaaggctgacaactcttttatggagtttgagcttgctcccagcagggaagacaagttcgagtttttttcctgcttcaaggatggtagagagcagtcttcagcctgagacccatccctaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagatggaaaggagcctggctctgtcacccaggctggagtgcagtggcgtgatctcagctcactgcaagctccacctcttgggttcacgtgattctcctgcctcagcctcctga

SEQ ID NO: 9672 - DNA, 2327 bp, Artificial Sequence
  Synthetic polypeptide
ggtggcccgtacagggagcccattctcctctggggaggggtctccagtactttcccgtgtggaggcgcgcccagtcaccttgttgcggtagcctcaaggtgaggaatcgagacccaccaagtatgatgaataaacccagactctcagcaatgcaggaaaggaacaaacgggcagcttgggaaaagggggctcacataccacagcgactaggtaaactctacacagaccaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9673 - DNA, 1916 bp, Artificial Sequence
  Synthetic polypeptide
ggtggcccgtacagggagcccattctcctctggggaggggtctccagtactttcccgtgtggaggcgcgcccagtcaccttgttgcggtagcctcaaggtgaggaatcgagacccaccaagtatgatgaataaacccagactctcagcaatgcaggaaaggaacaaacgggcagcttgggaaaagggggctcacataccacagcgactaggtaaactctacacagaccaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgatggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9674 - DNA, 2384 bp, Artificial Sequence
  Synthetic polypeptide
ggtggcccgtacagggagcccattctcctctggggaggggtctccagtactttcccgtgtggaggcgcgcccagtcaccttgttgcggtagcctcaaggtgaggaatcgagacccaccaagtatgatgaataaacccagactctcagcaatgcaggaaaggaacaaacgggcagcttgggaaaagggggctcacataccacagcgactaggtaaactctacacagaccaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9675 - DNA, 2195 bp, Artificial Sequence
  Synthetic polypeptide
ggtggcccgtacagggagcccattctcctctggggaggggtctccagtactttcccgtgtggaggcgcgcccagtcaccttgttgcggtagcctcaaggtgaggaatcgagacccaccaagtatgatgaataaacccagactctcagcaatgcaggaaaggaacaaacgggcagcttgggaaaagggggctcacataccacagcgactaggtaaactctacacagaccaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9676 - DNA, 2911 bp, Artificial Sequence
  Synthetic polypeptide
gcctggtgtggaggctcacgcctgtaatcccagcactttgggaggccaaggcgggcggatcacttgaagtcaggagttcaagatcagcctggccaacatggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggaaggcgtgaccatggctgatgagatgtcctctccccctgcagacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtga

SEQ ID NO: 9677 - DNA, 2869 bp, Artificial Sequence
  Synthetic polypeptide
gcctggtgtggaggctcacgcctgtaatcccagcactttgggaggccaaggcgggcggatcacttgaagtcaggagttcaagatcagcctggccaacatggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtga

SEQ ID NO: 9678 - DNA, 1110 bp, Artificial Sequence; identical to SEQ ID NO: 8310
  Synthetic polypeptide

SEQ ID NO: 9679 - DNA, 519 bp, Artificial Sequence
  Synthetic polypeptide
tattacagttcttacctgtccttgtttacagtctgtaccggctaggtgctgagcggcttgaaggctggctttgctacagctgaccactccagtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattga

SEQ ID NO: 9680 - DNA, 213 bp, Artificial Sequence
  Synthetic polypeptide
tattacagttcttacctgtccttgtttacagtctgtaccggctaggtgctgagcggcttgaaggctggctttgctacagctgaccactccagtcaggagagagagactgagaaggctatggatcgactagccagtcctctctgctgcttagtggccttctctgcccagttgaacagtaacctcctttggaagccttgcttggagcttccttaa

SEQ ID NO: 9681 - DNA, 1692 bp, Artificial Sequence
  Synthetic polypeptide
gcaattccccctttccttgtttttgcttatgctgtttttatccaaccatgatgtttttcccaccacatcaccctggaccaaactttttcaaatcccatcttataagctactttctccatctaataccttttaagtatccatttccttatctcccaaccagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaa

SEQ ID NO: 9682 - DNA, 569 bp, Artificial Sequence
  Synthetic polypeptide
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaac

SEQ ID NO: 9683 - DNA, 1940 bp, Artificial Sequence
  Synthetic polypeptide
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctga

SEQ ID NO: 9684 - DNA, 1751 bp, Artificial Sequence
  Synthetic polypeptide
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttga

SEQ ID NO: 9685 - DNA, 1946 bp, Artificial Sequence
  Synthetic polypeptide
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcaggatctggggccagctcacctctcacgtccccgtcatcgccaactccaccctctacatcagctgccttaggtttgagtaaaagatgtaaagaaagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtga

SEQ ID NO: 9686 - DNA, 629 bp, Artificial Sequence
  Synthetic polypeptide
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgcacccttacatctatcgggttacctttgccacagctaa

SEQ ID NO: 9687 - DNA, 1579 bp, Artificial Sequence
  Synthetic polypeptide
ccttgctgcccagagtgtggtctgtggagtcacagcgttacctgggagctgatgaaaaatgcagaatctcgggcctgcttagacctgtgagtcagaagcgacggcttaggagccccagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaa

SEQ ID NO: 9688 - DNA, 1399 bp, Artificial Sequence
  Synthetic polypeptide
ccttgctgcccagagtgtggtctgtggagtcacagcgttacctgggagctgatgaaaaatgcagaatctcgggcctgcttagacctgtgagtcagaagcgacggcttaggagccccagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtgggtaagacagcatgtggcaagttgggcagggtcttgttttatttccctagagctgggtttctcagtcttccaaaaggaatcttctgtgaaagtccaatgtttaaaaagtggtaa

SEQ ID NO: 9689 - DNA, 763 bp, Artificial Sequence
  Synthetic polypeptide
ccttgctgcccagagtgtggtctgtggagtcacagcgttacctgggagctgatgaaaaatgcagaatctcgggcctgcttagacctgtgagtcagaagcgacggcttaggagccccagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataa

SEQ ID NO: 9690 - DNA, 1029 bp, Artificial Sequence
  Synthetic polypeptide
gaggtcatgggaacccagacactttcagatgctgatggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9691 - DNA, 957 bp, Artificial Sequence
  Synthetic polypeptide
gaggtcatgggaacccagacactttcagatgctgatggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9692 - DNA, 705 bp, Artificial Sequence
  Synthetic polypeptide
gaggtcatgggaacccagacactttcagatgctgatggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9693 - DNA, 427 bp, Artificial Sequence
  Synthetic polypeptide
gaggtcatgggaacccagacactttcagatgctgatggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaact

SEQ ID NO: 9694 - DNA, 1325 bp, Artificial Sequence; identical to SEQ ID NO: 7686
  Synthetic polypeptide

SEQ ID NO: 9695 - DNA, 1691 bp, Artificial Sequence; identical to SEQ ID NO: 7687
  Synthetic polypeptide

SEQ ID NO: 9696 - DNA, 1541 bp, Artificial Sequence; identical to SEQ ID NO: 7688
  Synthetic polypeptide

SEQ ID NO: 9697 - DNA, 1420 bp, Artificial Sequence
  Synthetic polypeptide
gaaggccaaggcgggagcatggcttgagcccaggagttcgagaccggcctgggccacatggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactga

SEQ ID NO: 9698 - DNA, 1033 bp, Artificial Sequence
  Synthetic polypeptide
gaggtcatgggaacccagacactttcagatgctgatggtgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9699 - DNA, 961 bp, Artificial Sequence
  Synthetic polypeptide
gaggtcatgggaacccagacactttcagatgctgatggtgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9700 - DNA, 709 bp, Artificial Sequence
  Synthetic polypeptide
gaggtcatgggaacccagacactttcagatgctgatggtgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9701 - DNA, 431 bp, Artificial Sequence
  Synthetic polypeptide
gaggtcatgggaacccagacactttcagatgctgatggtgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaact

SEQ ID NO: 9702 - DNA, 1537 bp, Artificial Sequence
  Synthetic polypeptide
atctctcgcctggaccccagcatccaaacagatccccctgccccaggtcttgttccctctaatcctccctcaactgcagccagagtgatttaattgtatcaccacccccactcctacttaaaccccccactagccaagaagctgatccaaattcctttgtatggcattaagcgccctgctttccagcctggctgacctcatctctctccggccctcccctcctgctttgttccagagccaggtggaatgaaactgcctgtctctggactgtgtttattgcattccatccgccaggaatgccacccccacccttcctctcctgccccctgaatccgttctcctgactaacttctgatccttcaagactgagcttcaacttcacctttgtgaagctttccctgaacatcttcctccagggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtga

SEQ ID NO: 9703 - DNA, 856 bp, Artificial Sequence
  Synthetic polypeptide
gccgggcgcagtggctcacgcctgtaatcctagcactttgggaggccgaggcaggcagatcacaaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtag

SEQ ID NO: 9704 - DNA, 1222 bp, Artificial Sequence
  Synthetic polypeptide
gccgggcgcagtggctcacgcctgtaatcctagcactttgggaggccgaggcaggcagatcacaaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 9705 - DNA, 1072 bp, Artificial Sequence
  Synthetic polypeptide
gccgggcgcagtggctcacgcctgtaatcctagcactttgggaggccgaggcaggcagatcacaaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 9706 - DNA, 1073 bp, Artificial Sequence
  Synthetic polypeptide
ttagagccctagacttctttgtttgaaagatacctgctggactagcagtctttcttcctgtctctctctgtctggagggaggattgatccctgacttcctgggttggtagtttttcttcctggctctcagtcttgagtgggaaatttttcttggctctttgtgaggcctctccattctctctattttatcctgtttctctcatggaaaattctcagttggctgaaactcccttcttgaactcctactgactatatgctctaccaatctgtccacctccttcctgttggcataaatttgcagagaataatttggaacttcattgtcctctttgggaaacttatgatctccccaaactggcttctgtaaggcctctcccttcccattcctcctttgttctttaaccacttttgatcttcccttcagcgaccttgaagcctttgatatatcccccttttaactctaccaccttcatccctctgttcattctgccaggcttttcatttcccacttcaacctctcagctcccaacagtcacttgaactatagaccccttggcctccattgggggctctccttaagagactgagggatccctgagggatccccaaaagcaatgattagaggctgaaaacagaaaaaaaactttggaaacagactggatgttttgtacactcaggtgagtgttggatacacacaaacagcttcataataattcaccaaaattttagcccacaacttccctaagatgacaaagaaagtcttaaaaatgtctgctacaaatgttggtgaacagatatccttaatttgtcctatttgccagaaacgtgatttggataaaaatataaagtagaagaaagagaatccgacaacagctgctccagctgacacgtatccagctactggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctga

SEQ ID NO: 9707 - DNA, 2087 bp, Artificial Sequence
  Synthetic polypeptide
tggaggaaaagttaaatattaaatctgaattcaattgaacctggacacaaacaatagtcaccaagtcctggaacaagttttgtgagtcccttgaggctttcatccagcgctgtttcagagaaatctctatttcaatctattcctatacattagttattgaaaaacaatagacaatagcaaaaacaagttgacctttttgtgttccttgagcctggttgtgaagggcccttgtgactgggcctcatgccaaacaacttgttacaaaaagagctagggtcccaggcccagccgaagcttcaggagacctatcctcatctgtgcaaggaggagtggccaactctggagcccaggctgttgcttcctggtctggtggtgaatcctccatagtctggtgagtgtagtgcccaactctggagcccaggatgttgcttcccggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataa

SEQ ID NO: 9708 - DNA, 581 bp, Artificial Sequence
  Synthetic polypeptide
tggaggaaaagttaaatattaaatctgaattcaattgaacctggacacaaacaatagtcaccaagtcctggaacaagttttgtgagtcccttgaggctttcatccagcgctgtttcagagaaatctctatttcaatctattcctatacattagttattgaaaaacaatagacaatagcaaaaacaagttgacctttttgtgttccttgagcctggttgtgaagggcccttgtgactgggcctcatgccaaacaacttgttacaaaaagagctagggtcccaggcccagccgaagcttcaggagacctatcctcatctgtgcaaggaggagtggccaactctggagcccaggctgttgcttcctggtctggtggtgaatcctccatagtctggtgagtgtagtgcccaactctggagcccaggatgttgcttcccggtctggtggtgaatcctccatagtctggagatctcagccctgctgagctgatgatgctgactataggagatgttattaaacaactgattgaagcccacgagcaggggaaagacatcgatctaaataaattgctgtcgtggctgtga

SEQ ID NO: 9709 - DNA, 624 bp, Artificial Sequence
  Synthetic polypeptide
gtaccagtccatggcctgttaggaagtgggctgtacagcagggggtgtacagtggggagcaagcaatgcttcatctgcatttatggccactccccatggttggcactactgcctgagctccgcctcctgtcagatcagtggtagcatgagattctcctaggagcacaaaccctattgtgaactgagcatgcaaaggatctgggctgcatgctccttatgagaatctaatgcctgatgatctgtcactgtctcctatcacccccagatgagaccatctaattacaggaaaacaagctagggcccgcactgattctaaattacggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactga

SEQ ID NO: 9710 - DNA, 294 bp, Artificial Sequence; identical to SEQ ID NO: 6413
  Synthetic polypeptide

SEQ ID NO: 9711 - DNA, 462 bp, Artificial Sequence; identical to SEQ ID NO: 6414
  Synthetic polypeptide

SEQ ID NO: 9712 - DNA, 522 bp, Artificial Sequence; identical to SEQ ID NO: 6415
  Synthetic polypeptide

SEQ ID NO: 9713 - DNA, 414 bp, Artificial Sequence; identical to SEQ ID NO: 6416
  Synthetic polypeptide

SEQ ID NO: 9714 - DNA, 405 bp, Artificial Sequence; identical to SEQ ID NO: 6417
  Synthetic polypeptide

SEQ ID NO: 9715 - DNA, 2016 bp, Artificial Sequence
  Synthetic polypeptide
tggaggaaaagttaaatattaaatctgaattcaattgaacctggacacaaacaatagtcaccaagtcctggaacaagttttgtgagtcccttgaggctttcatccagcgctgtttcagagaaatctctatttcaatctattcctatacattagttattgaaaaacaatagacaatagcaaaaacaagttgacctttttgtgttccttgagcctggttgtgaagggcccttgtgactgggcctcatgccaaacaacttgttacaaaaagagctagggtcccaggcccagccgaagcttcaggagacctatcctcatctgtgcaaggaggagtggccaactctggagcccaggctgttgcttcctggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataa

SEQ ID NO: 9716 - DNA, 510 bp, Artificial Sequence
  Synthetic polypeptide
tggaggaaaagttaaatattaaatctgaattcaattgaacctggacacaaacaatagtcaccaagtcctggaacaagttttgtgagtcccttgaggctttcatccagcgctgtttcagagaaatctctatttcaatctattcctatacattagttattgaaaaacaatagacaatagcaaaaacaagttgacctttttgtgttccttgagcctggttgtgaagggcccttgtgactgggcctcatgccaaacaacttgttacaaaaagagctagggtcccaggcccagccgaagcttcaggagacctatcctcatctgtgcaaggaggagtggccaactctggagcccaggctgttgcttcctggtctggtggtgaatcctccatagtctggagatctcagccctgctgagctgatgatgctgactataggagatgttattaaacaactgattgaagcccacgagcaggggaaagacatcgatctaaataaattgctgtcgtggctgtga

SEQ ID NO: 9717 - DNA, 613 bp, Artificial Sequence
  Synthetic polypeptide
cagtatcactgtttgattaagtaaggggggcacctgccttgggccccacaatttagagatacctgctctggtccttctgctgcctgcacccctccccacagagtgaggaatccatagggctaagaatatgcctacctagatcccttctgttgcttgcttgggtacctgaaacccagaattctctgtccacatggtccaaaatgtatttccagggtctccatgcatctttttctgggctccattcttttgagggcgggtcccgtctctgatatgtatacctctaggcctgagagtttgctgatggcagctgtttctgagggcatgtggacattacccaaagtgtccacactcgtatgtgagacctcttgaggtgcagggtggatggggttggaaaagcagggaggttttctgagggctaggcacctggggctggctttcctcatgtcactactttccagtgcagaatcctgaggagtctggagaattctaagtttgaatctgttctcctggtcgctgtgaaagtatatttgttaaggaattcaaccttattgatagaagagaacttgcaccactccaagaactgattgaaaaactcacctcaaaagacagataa

SEQ ID NO: 9718 - DNA, 820 bp, Artificial Sequence
  Synthetic polypeptide
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 9719 - DNA, 307 bp, Artificial Sequence
  Synthetic polypeptide
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggccaggtga

SEQ ID NO: 9720 - DNA, 622 bp, Artificial Sequence
  Synthetic polypeptide
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 9721 - DNA, 718 bp, Artificial Sequence
  Synthetic polypeptide
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 9722 - DNA, 409 bp, Artificial Sequence
  Synthetic polypeptide
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 9723 - DNA, 691 bp, Artificial Sequence
  Synthetic polypeptide
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 9724 - DNA, 751 bp, Artificial Sequence
  Synthetic polypeptide
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 9725 - DNA, 838 bp, Artificial Sequence
  Synthetic polypeptide
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 9726 - DNA, 2105 bp, Artificial Sequence
  Synthetic polypeptide
ggctgggtgcagtggctcatgcctgtactcccagcactttgggaggctgaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaa

SEQ ID NO: 9727 - DNA, 1592 bp, Artificial Sequence
  Synthetic polypeptide
ggctgggtgcagtggctcatgcctgtactcccagcactttgggaggctgaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaa

SEQ ID NO: 9728 - DNA, 2147 bp, Artificial Sequence
  Synthetic polypeptide
ggctgggtgcagtggctcatgcctgtactcccagcactttgggaggctgaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagatggaaaggagcctggctctgtcacccaggctggagtgcagtggcgtgatctcagctcactgcaagctccacctcttgggttcacgtgattctcctgcctcagcctcctga

SEQ ID NO: 9729 - DNA, 352 bp, Artificial Sequence
  Synthetic polypeptide
caaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatga

SEQ ID NO: 9730 - DNA, 175 bp, Artificial Sequence
  Synthetic polypeptide
caaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggtgagtatctggctgcactga

SEQ ID NO: 9731 - DNA, 1077 bp, Artificial Sequence
  Synthetic polypeptide
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9732 - DNA, 717 bp, Artificial Sequence
  Synthetic polypeptide
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9733 - DNA, 949 bp, Artificial Sequence
  Synthetic polypeptide
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 9734 - DNA, 279 bp, Artificial Sequence
  Synthetic polypeptide
gcaatggctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaa

SEQ ID NO: 9735 - DNA, 270 bp, Artificial Sequence
  Synthetic polypeptide
gcaatggctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgatccagcagatgttgactga

SEQ ID NO: 9736 - DNA, 250 bp, Artificial Sequence
  Synthetic polypeptide
gcaatggctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacg

SEQ ID NO: 9737 - DNA, 396 bp, Artificial Sequence; identical to SEQ ID NO: 6456
  Synthetic polypeptide

SEQ ID NO: 9738 - DNA, 564 bp, Artificial Sequence; identical to SEQ ID NO: 6457
  Synthetic polypeptide

SEQ ID NO: 9739 - DNA, 624 bp, Artificial Sequence; identical to SEQ ID NO: 6458
  Synthetic polypeptide

SEQ ID NO: 9740 - DNA, 516 bp, Artificial Sequence; identical to SEQ ID NO: 6459
  Synthetic polypeptide

SEQ ID NO: 9741 - DNA, 507 bp, Artificial Sequence; identical to SEQ ID NO: 6460
  Synthetic polypeptide

SEQ ID NO: 9742 - DNA, 116 bp, Artificial Sequence
  Synthetic polypeptide
aggagaaccctgcagtgtccagctaagctgatgacttgaagataaatctgcctaaccctgggatgaagtatctgtgaactattttgacagcagatgaggaattttggggaaattaa

SEQ ID NO: 9743 - DNA, 877 bp, Artificial Sequence
  Synthetic polypeptide
aggaaccacacagtttggcggggggtgcccaggctttggagtcagaccaacctggatttgaactctggcttgactgcttacgagccatgagaatctagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 9744 - DNA, 844 bp, Artificial Sequence
  Synthetic polypeptide
aggaaccacacagtttggcggggggtgcccaggctttggagtcagaccaacctggatttgaactctggcttgactgcttacgagccatgagaatctagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 9745 - DNA, 1325 bp, Artificial Sequence
  Synthetic polypeptide
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaa

SEQ ID NO: 9746 - DNA, 407 bp, Artificial Sequence
  Synthetic polypeptide
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagccctttga

SEQ ID NO: 9747 - DNA, 1220 bp, Artificial Sequence
  Synthetic polypeptide
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaa

SEQ ID NO: 9748 - DNA, 338 bp, Artificial Sequence
  Synthetic polypeptide
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtatcaactttgccaagcttatgtag

SEQ ID NO: 9749 - DNA, 751 bp, Artificial Sequence
  Synthetic polypeptide
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcat

SEQ ID NO: 9750 - DNA, 353 bp, Artificial Sequence
  Synthetic polypeptide
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgagatggtattggcccagaaatttcagctgcagttatga

SEQ ID NO: 9751 - DNA, 473 bp, Artificial Sequence
  Synthetic polypeptide
agacaggcctgagcagaatctggtttacctggctctgggatcttgagaagataatttcatctcttggatcctagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctag

SEQ ID NO: 9752 - DNA, 1477 bp, Artificial Sequence
  Synthetic polypeptide
tgaaataatacagaaaaagtactcaagacagtccctgattcatagtaagttccagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatgtaagtacatcacagtaaatattagttatgtaaacattttcagaatgtga

SEQ ID NO: 9753 - DNA, 795 bp, Artificial Sequence
  Synthetic polypeptide
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataa

SEQ ID NO: 9754 - DNA, 498 bp, Artificial Sequence
  Synthetic polypeptide
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataa

SEQ ID NO: 9755 - DNA, 591 bp, Artificial Sequence
  Synthetic polypeptide
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagtcatcattccccggattgaacgtactcttgcttatatcatcacagagctggatgagagagagcgagaagagttctataggttaa

SEQ ID NO: 9756 - DNA, 312 bp, Artificial Sequence
  Synthetic polypeptide
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcaggtgttactttgccagtatttga

SEQ ID NO: 9757 - DNA, 269 bp, Artificial Sequence
  Synthetic polypeptide
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaa

SEQ ID NO: 9758 - DNA, 317 bp, Artificial Sequence
  Synthetic polypeptide
ccttgagaggtgctttctctccctgaaggtcacagctgcaggcataccagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgttttaa

SEQ ID NO: 9759 - DNA, 461 bp, Artificial Sequence
  Synthetic polypeptide
ccttgagaggtgctttctctccctgaaggtcacagctgcaggcataccagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttga

SEQ ID NO: 9760 - DNA, 345 bp, Artificial Sequence
  Synthetic polypeptide
ccttgagaggtgctttctctccctgaaggtcacagctgcaggcataccagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctg

SEQ ID NO: 9761 - DNA, 407 bp, Artificial Sequence
  Synthetic polypeptide
ccttgagaggtgctttctctccctgaaggtcacagctgcaggcataccagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctggtaagtggcaaatgggaacttaccattttggggaaatgggatttgtgagcatatgctgttaa

SEQ ID NO: 9762 - DNA, 3012 bp, Artificial Sequence
  Synthetic polypeptide
gatgttctatttcttgatctggatgctgcttcttcagtttgtggacgtttatcagaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaa

SEQ ID NO: 9763 - DNA, 2528 bp, Artificial Sequence
  Synthetic polypeptide
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9764 - DNA, 2400 bp, Artificial Sequence
  Synthetic polypeptide
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 9765 - DNA, 2168 bp, Artificial Sequence
  Synthetic polypeptide
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9766 - DNA, 96 bp, Artificial Sequence
  Synthetic polypeptide
agtgtttcccgcccaggctgcattttagaatcacagaggaggtggcccgaggcagccgggatgacagctctccccaggaatcctgctgcctgctga

SEQ ID NO: 9767 - DNA, 848 bp, Artificial Sequence
  Synthetic polypeptide
tatacatgtccccctaggtctacaggatgctttccaagggttatggagacaggagtgattataagatgaccactttccagatcctgagtgcctatatgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgagtttgaggccgacagacgtgcttttatcatcactcttaactcctttggcactgaattgagcaaagaagaccgagagaccctctatccaaccttcggcaaactctatcctgaggggttgcggctgttggctcaagcagaagactttgaccagatgaagaacgtagcggatcattacggagtatacaaacctttatttgaagctgtaggtggcagtgggggaaagacattggaggacgtgttttacgagcgtgaggtacaaatgaatgtgctggcattcaacagacagttccactacggtgtgttttatgcatatgtaaagctgaaggaacaggaaattagaaatattgtgtggatagcagaatgtatttcacagaggcatcgaactaaaatcaacagttacattccaattttataa

SEQ ID NO: 9768 - DNA, 1083 bp, Artificial Sequence
  Synthetic polypeptide
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9769 - DNA, 723 bp, Artificial Sequence
  Synthetic polypeptide
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9770 - DNA, 2509 bp, Artificial Sequence
  Synthetic polypeptide
cactcagccctttgtatctgtgggttatgcatcaagggattcaattatctgagaatcaaaaatatttgaaaaaacataataaaacaataaaaataattaaaaagtaatatagtataattatttacatagtgtttacatagtattagtattataaataacatagagatgatttaaagtatgcaggaggatgtatgtaggttatatgcaaatactatgctattttatatgcaggacttgagcatctgaagattttggtttctgcagagggtgggaaaggttgaaccaatcccccatggataccaaggcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtggttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaa

SEQ ID NO: 9771 - DNA, 505 bp, Artificial Sequence
  Synthetic polypeptide
cactcagccctttgtatctgtgggttatgcatcaagggattcaattatctgagaatcaaaaatatttgaaaaaacataataaaacaataaaaataattaaaaagtaatatagtataattatttacatagtgtttacatagtattagtattataaataacatagagatgatttaaagtatgcaggaggatgtatgtaggttatatgcaaatactatgctattttatatgcaggacttgagcatctgaagattttggtttctgcagagggtgggaaaggttgaaccaatcccccatggataccaaggcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctg

SEQ ID NO: 9772 - DNA, 486 bp, Artificial Sequence
  Synthetic polypeptide
cactcagccctttgtatctgtgggttatgcatcaagggattcaattatctgagaatcaaaaatatttgaaaaaacataataaaacaataaaaataattaaaaagtaatatagtataattatttacatagtgtttacatagtattagtattataaataacatagagatgatttaaagtatgcaggaggatgtatgtaggttatatgcaaatactatgctattttatatgcaggacttgagcatctgaagattttggtttctgcagagggtgggaaaggttgaaccaatcccccatggataccaaggcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccc

SEQ ID NO: 9773 - DNA, 490 bp, Artificial Sequence
  Synthetic polypeptide
ggtttggctctgtgttcccacccaaatctcatcttgaattgtaattcccacatattgagggagggacccgtgatccccacatgttgagggagggaggtgattgaatcatgggggtggtttcccccatactgttctcatgatagtgagtgagttctcatgagatctggtggtttttataagtgtttcaatagttcctctcttgctcccttctctctcctgctgccttctgaaaaaggtgcttgcttcctcttcaccttctgccacgattgtaagtttcctgaggcctccccagccatgcagaactcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctga

SEQ ID NO: 9774 - DNA, 1116 bp, Artificial Sequence
  Synthetic polypeptide
cagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatgagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaa

SEQ ID NO: 9775 - DNA, 447 bp, Artificial Sequence
  Synthetic polypeptide
cagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatgagtgcagacatgagtccagcaagcagtaccacgtcacttcctgttagtcctcttactgaagagccagtgcctttcaagaccacataccctagggaattctga

SEQ ID NO: 9776 - DNA, 645 bp, Artificial Sequence
  Synthetic polypeptide
cagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatgagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatgccctgtggaatcctacatgcactgaaggtttatttaaaccagtacttatttcaacttag

SEQ ID NO: 9777 - DNA, 756 bp, Artificial Sequence; identical to SEQ ID NO: 8739
  Synthetic polypeptide

SEQ ID NO: 9778 - DNA, 918 bp, Artificial Sequence
  Synthetic polypeptide
cttgtccgagcctcagttttctcttcgaggaaatgggagtttggaggtgggcttctggcctgcttttcctcacctcgtggttaggagggcgcatgcgaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttgtgcacaaggaagaaagcctggggcccaagagacagaaagttggattcctgggatga

SEQ ID NO: 9779 - DNA, 956 bp, Artificial Sequence
  Synthetic polypeptide
ctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtag

SEQ ID NO: 9780 - DNA, 1142 bp, Artificial Sequence
  Synthetic polypeptide
ctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtag

SEQ ID NO: 9781 - DNA, 641 bp, Artificial Sequence
  Synthetic polypeptide
ctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagtgacgagctcatcttcttggaccctcatacaacccagacctttgttgacactgaagagaatggaacggttaatgaccagactttccattgcctgcagtccccacagcgaatga

SEQ ID NO: 9782 - DNA, 632 bp, Artificial Sequence
  Synthetic polypeptide
caggcgcggtagctcacgcctgtaatcccagcactttgggaagccgaggcgggtcgatcacgaggtcaggagattgagaccatcctggctaacacagtgaaaccccgtctctactaaaaatacaaaaaaaaaaaaaaaaaaaaatttagcccagcgtggtggctgtcccagcctgaagtcccagctactcaggaggctgaggcaggagaatggtgtgaatccgggaggcggagcttgcagtgagccaagatcgcaccactacactccagcctgggcaacagagcattctggaatttatcagtatagcagtgggcctggtcagcattcgaggcgtggacagtggactctacctcgggatgaatgagaagggggagctgtatggatcagaaaaactaacccaagagtgtgtattcagagaacagttcgaagaaaactggtataatacgtactcatcaaacctatataagcacgtggacactggaaggcgatactatgttgcattaaataaagatgggaccccgagagaagggactaggactaaacggcaccagaaattcacacattttttacctagaccagtggaccccgacaaagtacctgaactgtataaggatattctaagccaaagttga

SEQ ID NO: 9783 - DNA, 775 bp, Artificial Sequence
  Synthetic polypeptide
tggagagaggccaacccgggactctattccttatgagctgtgtggccatagccaagtagctgtttctctctgagactcaatgtcctcatctgtaaaatgcggaaaagaaagctgacctgatgggactgttgggagggatagctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagggtgccagacataggacctcaaaaacctctggtgcccaatgccctccgatgacttcagcaacctgcctgctggctgcacgtgtggctcttctctccgcagcgctggtgcgcgaagccaccgggcgcacagcccagcgctgtcgtctgagtccgcgggcggccgccgagcgcctgctggggccgccacctcacgttgcagcaggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctga

SEQ ID NO: 9784 - DNA, 586 bp, Artificial Sequence
  Synthetic polypeptide
tggagagaggccaacccgggactctattccttatgagctgtgtggccatagccaagtagctgtttctctctgagactcaatgtcctcatctgtaaaatgcggaaaagaaagctgacctgatgggactgttgggagggatagctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtga

SEQ ID NO: 9785 - DNA, 731 bp, Artificial Sequence
  Synthetic polypeptide
ggagtagtatattgcagtggttaaaggcataggcttgggagtcacagaagtctacatttgaatctatactctgctacttcctacaaccatcctattggacaggttgtttgatctctctgaatctgttttcttcatttataaaataattacacttatttcatagagttgtgaagattaaaggaaataaaagcctgtaatctagagcctggcacagtcagcattaatggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaa

SEQ ID NO: 9786 - DNA, 1500 bp, Artificial Sequence
  Synthetic polypeptide
ggccaggcacagtggctcacacctgtaatcccagcactttgggaggccaaggcaggtagatcacctgaggtccggagttcaagaccagcctagtcaacatggtgaaaccccgtctctactaaaaatacaaaaattagctggtcgtggtggtgcatgcctgtagtcccagttactcgggaggctgacgcaggagaatcacttgaacccgggaggcagaggttgcagtgagccgagatcgcgccactgcactccagcctgggctacagaggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttga

SEQ ID NO: 9787 - DNA, 1304 bp, Artificial Sequence
  Synthetic polypeptide
tgccccaggcccccagctgtgctcctcctccttcctctgcactcatcccccacccacctcagggcctttgcacttgccatggcctctgcctggactgccctcccccttctctacctgcagaacgtcgtttagccttcatcgttcacctcaaatatcacctctgcagagattttcctcactccctgtgccacctagcagaaactggtccttcctcctcctgctgcccgtggcatgcacgtcttcttcaggctccacattgccatcatggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtag

SEQ ID NO: 9788 - DNA, 1403 bp, Artificial Sequence
  Synthetic polypeptide
tgccccaggcccccagctgtgctcctcctccttcctctgcactcatcccccacccacctcagggcctttgcacttgccatggcctctgcctggactgccctcccccttctctacctgcagaacgtcgtttagccttcatcgttcacctcaaatatcacctctgcagagattttcctcactccctgtgccacctagcagaaactggtccttcctcctcctgctgcccgtggcatgcacgtcttcttcaggctccacattgccatcatggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctga

SEQ ID NO: 9789 - DNA, 1355 bp, Artificial Sequence
  Synthetic polypeptide
tgccccaggcccccagctgtgctcctcctccttcctctgcactcatcccccacccacctcagggcctttgcacttgccatggcctctgcctggactgccctcccccttctctacctgcagaacgtcgtttagccttcatcgttcacctcaaatatcacctctgcagagattttcctcactccctgtgccacctagcagaaactggtccttcctcctcctgctgcccgtggcatgcacgtcttcttcaggctccacattgccatcatggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaa

SEQ ID NO: 9790 - DNA, 2438 bp, Artificial Sequence
  Synthetic polypeptide
cggggctgcggggcgaacggcgcggctaggatccggcggctcagcccggggcggcgaggctcggcacggagatggcggcgcgctcggcgcaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacatgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtatcctctgtccccgcgcgatgcgcgcttcttccgccgtctggagcggccggccaaggacagcgagggcagctcagacagcgacgccgatgagctggccgcgccctacagccagggtctggacaactga

SEQ ID NO: 9791 - DNA, 2471 bp, Artificial Sequence
  Synthetic polypeptide
cggggctgcggggcgaacggcgcggctaggatccggcggctcagcccggggcggcgaggctcggcacggagatggcggcgcgctcggcgcaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacatgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggagagcgctgctctggctgataggttaatccaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtatcctctgtccccgcgcgatgcgcgcttcttccgccgtctggagcggccggccaaggacagcgagggcagctcagacagcgacgccgatgagctggccgcgccctacagccagggtctggacaactga

SEQ ID NO: 9792 - DNA, 1430 bp, Artificial Sequence
  Synthetic polypeptide
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaa

SEQ ID NO: 9793 - DNA, 467 bp, Artificial Sequence
  Synthetic polypeptide
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgttcacagcatcttcaaccaggagcagattctatctcaagaaaccactttgtttgctcatccataa

SEQ ID NO: 9794 - DNA, 1307 bp, Artificial Sequence
  Synthetic polypeptide
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagcggcaaagaagtttgtttctggccagaagtcaatggcagcaagtggaaatttgggacatacaccttttgttgatgagttgtaatactgatgcacacattacaggagagagctga

SEQ ID NO: 9795 - DNA, 1079 bp, Artificial Sequence
  Synthetic polypeptide
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgaacaagctgaaagctggatacctaatgtcagtggagtcttctga

SEQ ID NO: 9796 - DNA, 419 bp, Artificial Sequence
  Synthetic polypeptide
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagggaaatgggtaaagtatga

SEQ ID NO: 9797 - DNA, 499 bp, Artificial Sequence
  Synthetic polypeptide
gtggagagatccctagagatgcagtctgtggccctgggttccaacccagtgtgccaccacctggctgtgtgaccttcagcaagtgccattatttctctgagcctgtttgtttataaaatgaggaagagttggcacaagtttgaaaagatttctcaggctccacccggttctgaaattcgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttc

SEQ ID NO: 9798 - DNA, 1050 bp, Artificial Sequence
  Synthetic polypeptide
gtggagagatccctagagatgcagtctgtggccctgggttccaacccagtgtgccaccacctggctgtgtgaccttcagcaagtgccattatttctctgagcctgtttgtttataaaatgaggaagagttggcacaagtttgaaaagatttctcaggctccacccggttctgaaattcgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggctt

SEQ ID NO: 9799 - DNA, 1978 bp, Artificial Sequence
  Synthetic polypeptide
gtggagagatccctagagatgcagtctgtggccctgggttccaacccagtgtgccaccacctggctgtgtgaccttcagcaagtgccattatttctctgagcctgtttgtttataaaatgaggaagagttggcacaagtttgaaaagatttctcaggctccacccggttctgaaattcgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctga

SEQ ID NO: 9800 - DNA, 1255 bp, Artificial Sequence
  Synthetic polypeptide
gcagggcacagtggctcacgcctgtaatcccagcactttggaaggccaacgcaggaggatcgcttgagcccaggagtttgagaccagcttggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtag

SEQ ID NO: 9801 - DNA, 460 bp, Artificial Sequence
  Synthetic polypeptide
gcagggcacagtggctcacgcctgtaatcccagcactttggaaggccaacgcaggaggatcgcttgagcccaggagtttgagaccagcttggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcagatcaagcaagagacaggctccttagcaaaaatatgctgtcatgtcaggaggtga

SEQ ID NO: 9802 - DNA, 397 bp, Artificial Sequence
  Synthetic polypeptide
gcagggcacagtggctcacgcctgtaatcccagcactttggaaggccaacgcaggaggatcgcttgagcccaggagtttgagaccagcttggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggatgtgatggtggcaggtgggatggagagcatgtccaatgttccatatgtaatgaacagaggatcaacaccatatggtggggtaaagcttga

SEQ ID NO: 9803 - DNA, 306 bp, Artificial Sequence
  Synthetic polypeptide
cttcctgggttcaaacaccagctctacccctgacttgctgtataactgtgggggaatttcttctctgcacttccaccctcttgtggattacaccagaatgacattgacgcctcataaggttgccataatggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaa

SEQ ID NO: 9804 - DNA, 197 bp, Artificial Sequence
  Synthetic polypeptide
cttcctgggttcaaacaccagctctacccctgacttgctgtataactgtgggggaatttcttctctgcacttccaccctcttgtggattacaccagaatgacattgacgcctcataaggttgccataatggcggcagccccaagggggacgtggacccgttctactatggcagaagattccgctgtgggggcaataa

SEQ ID NO: 9805 - DNA, 1444 bp, Artificial Sequence
  Synthetic polypeptide
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatga

SEQ ID NO: 9806 - DNA, 766 bp, Artificial Sequence
  Synthetic polypeptide
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttga

SEQ ID NO: 9807 - DNA, 1531 bp, Artificial Sequence
  Synthetic polypeptide
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaatatttacagaatatttgcctcgagatgaaagcaaattcagatattaagatgctacagaaagggaaagaaggccagcaaattggcatattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatga

SEQ ID NO: 9808 - DNA, 1045 bp, Artificial Sequence
  Synthetic polypeptide
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaaggtatggaagctagaggggccactagaaaatcttgagaaaagtaaagttttgtttatatcacaagcaaagtccattgcagaaagcatcattattccaggactcagaatgctgaagagagaactgtgcccccagcagagtctttttctttctttctttctttctttttttttttttttttttttttttactgcatcaggattcaatacaatgagaatctactgcaatccaaaagcgcgaattgaaccttga

SEQ ID NO: 9809 - DNA, 796 bp, Artificial Sequence
  Synthetic polypeptide
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaag

SEQ ID NO: 9810 - DNA, 478 bp, Artificial Sequence
  Synthetic polypeptide
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgc

SEQ ID NO: 9811 - DNA, 397 bp, Artificial Sequence
  Synthetic polypeptide
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgt

SEQ ID NO: 9812 - DNA, 132 bp, Artificial Sequence
  Synthetic polypeptide
atccattagtgggtaatgtgaccaatttcatgagacgtaatttttttttttgaaaaaaaataaaatacaagtaccagagtaaatcacaagctataagcatctgacagatacgtctcatggtgtaagaaataa

SEQ ID NO: 9813 - DNA, 2518 bp, Artificial Sequence
  Synthetic polypeptide
atccattagtgggtaatgtgaccaatttcatgagacgtaatttttttttttgaaaaaaaataaaatacaagtaccagagtaaatcacaagctataagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaa

SEQ ID NO: 9814 - DNA, 1144 bp, Artificial Sequence
  Synthetic polypeptide
atccattagtgggtaatgtgaccaatttcatgagacgtaatttttttttttgaaaaaaaataaaatacaagtaccagagtaaatcacaagctataagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtaa

SEQ ID NO: 9815 - DNA, 1238 bp, Artificial Sequence
  Synthetic polypeptide
atgaatgaataaccaaattgtgatatatccatagaatgggatattatgccatcataaaaaggcatgaaggccctttttattgcataggaaggaatgctacaacatggatgaaccttggaaacattatgccagatgaaagaagccacctgcaattgaccacatattgtatgattctgtttatatgaactatccggaagaggcaaatccatggaggcagagagcagattagtggttgcccggtgctgagagcagggagagtgggaggtgactgcttcacaggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 9816 - DNA, 1205 bp, Artificial Sequence
  Synthetic polypeptide
atgaatgaataaccaaattgtgatatatccatagaatgggatattatgccatcataaaaaggcatgaaggccctttttattgcataggaaggaatgctacaacatggatgaaccttggaaacattatgccagatgaaagaagccacctgcaattgaccacatattgtatgattctgtttatatgaactatccggaagaggcaaatccatggaggcagagagcagattagtggttgcccggtgctgagagcagggagagtgggaggtgactgcttcacaggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 9817 - DNA, 290 bp, Artificial Sequence
  Synthetic polypeptide
gcaatgggtgcagtggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaa

SEQ ID NO: 9818 - DNA, 281 bp, Artificial Sequence
  Synthetic polypeptide
gcaatgggtgcagtggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgatccagcagatgttgactga

SEQ ID NO: 9819 - DNA, 261 bp, Artificial Sequence
  Synthetic polypeptide
gcaatgggtgcagtggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacg

SEQ ID NO: 9820 - DNA, 233 bp, Artificial Sequence
  Synthetic polypeptide
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaac

SEQ ID NO: 9821 - DNA, 1604 bp, Artificial Sequence
  Synthetic polypeptide
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctga

SEQ ID NO: 9822 - DNA, 1415 bp, Artificial Sequence
  Synthetic polypeptide
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttga

SEQ ID NO: 9823 - DNA, 1610 bp, Artificial Sequence
  Synthetic polypeptide
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcaggatctggggccagctcacctctcacgtccccgtcatcgccaactccaccctctacatcagctgccttaggtttgagtaaaagatgtaaagaaagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtga

SEQ ID NO: 9824 - DNA, 293 bp, Artificial Sequence
  Synthetic polypeptide
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgcacccttacatctatcgggttacctttgccacagctaa

SEQ ID NO: 9825 - DNA, 641 bp, Artificial Sequence
  Synthetic polypeptide
atctgagtttgtcagcctctttcttcagcctctcagcttccttggactttagggatcatatggtaaaggaaccagtggaagacacagaccctagcactttatcctttaatatgtcagacaaatatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttgctccgggcccccaccataagtgacttgctcaatgatcaggacttactagacgtgatcaggataaagctggatccgtgtcacccaacggtgaaaaactggaggaattttgcaagcaaatgggggatgtcctatgacgaattgtgcttcctggagcagaggccacagagccccaccttggagttcttgctccggaacagtcagaggacggtgggccagctgatggagctctgcaggctctaccacagggccgacgtggagaaggttctgcgcaggtgggtggacgaggagtggcccaagcgggagcgtggagacccctccaggcacttctag

SEQ ID NO: 9826 - DNA, 826 bp, Artificial Sequence
  Synthetic polypeptide
tatagtggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttgtgcacaaggaagaaagcctggggcccaagagacagaaagttggattcctgggatga

SEQ ID NO: 9827 - DNA, 560 bp, Artificial Sequence; identical to SEQ ID NO: 6322
  Synthetic polypeptide

SEQ ID NO: 9828 - DNA, 479 bp, Artificial Sequence; identical to SEQ ID NO: 8856
  Synthetic polypeptide

SEQ ID NO: 9829 - DNA, 692 bp, Artificial Sequence; identical to SEQ ID NO: 8857
  Synthetic polypeptide

SEQ ID NO: 9830 - DNA, 773 bp, Artificial Sequence; identical to SEQ ID NO: 8858
  Synthetic polypeptide

SEQ ID NO: 9831 - DNA, 1158 bp, Artificial Sequence
  Synthetic polypeptide
gccaggcacggaggctcatgcctataatcccagcactttgtgaggccaagataggaagatcagctgaggccaggagttcgagaccagtctgagcaacatggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaatcatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactga

SEQ ID NO: 9832 - DNA, 882 bp, Artificial Sequence
  Synthetic polypeptide
gccaggcacggaggctcatgcctataatcccagcactttgtgaggccaagataggaagatcagctgaggccaggagttcgagaccagtctgagcaacatggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaatcatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaatggcatcactattcatgaagttgtccaaacaagaaatacctatcatcgtttctctcctttatcccctgtatttagtcaccagtgcctatggatcatgcttccttaa

SEQ ID NO: 9833 - DNA, 1225 bp, Artificial Sequence
  Synthetic polypeptide
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggtaagtttcctgaggcctcccctgccatgcctcctgtgcagcctgcagaactgttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9834 - DNA, 865 bp, Artificial Sequence
  Synthetic polypeptide
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggtaagtttcctgaggcctcccctgccatgcctcctgtgcagcctgcagaactgttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9835 - DNA, 885 bp, Artificial Sequence
  Synthetic polypeptide
ggccaggtgcagtggctcacgcctgtaatcccagcactttgggaggccgaggtgggcggatcacctgaggtcaggggttcaagatcagcctgaccaacatgaagaaaccccatctctacaaaaaatacaaaattagccaggtgtggtggcgcatgcctgtaatcccagccacgctactcgggaggctgaggaaggagaatcgcttgaacccaggaggcagaggttacggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtag

SEQ ID NO: 9836 - DNA, 979 bp, Artificial Sequence
  Synthetic polypeptide
cagtggttcctggatggcagtccttaaacaggtgctacacatgaggacgttttcaccagcccacggtgagatgaggaaaatcaggacaacgaaaggaggtgtttacaaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataa

SEQ ID NO: 9837 - DNA, 404 bp, Artificial Sequence
  Synthetic polypeptide
cagtggttcctggatggcagtccttaaacaggtgctacacatgaggacgttttcaccagcccacggtgagatgaggaaaatcaggacaacgaaaggaggtgtttacaaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctgggg

SEQ ID NO: 9838 - DNA, 186 bp, Artificial Sequence; identical to SEQ ID NO: 7638
  Synthetic polypeptide

SEQ ID NO: 9839 - DNA, 2194 bp, Artificial Sequence
  Synthetic polypeptide
ggtggcccgtacagggagcccattctcctctggggaggggtctccagtactttcccgtgtggaggcgcgcccagtcaccttgttgcggtagcctcaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9840 - DNA, 1783 bp, Artificial Sequence
  Synthetic polypeptide
ggtggcccgtacagggagcccattctcctctggggaggggtctccagtactttcccgtgtggaggcgcgcccagtcaccttgttgcggtagcctcaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgatggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9841 - DNA, 2251 bp, Artificial Sequence
  Synthetic polypeptide
ggtggcccgtacagggagcccattctcctctggggaggggtctccagtactttcccgtgtggaggcgcgcccagtcaccttgttgcggtagcctcaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9842 - DNA, 2062 bp, Artificial Sequence
  Synthetic polypeptide
ggtggcccgtacagggagcccattctcctctggggaggggtctccagtactttcccgtgtggaggcgcgcccagtcaccttgttgcggtagcctcaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9843 - DNA, 677 bp, Artificial Sequence; identical to SEQ ID NO: 747
  Synthetic polypeptide

SEQ ID NO: 9844 - DNA, 674 bp, Artificial Sequence; identical to SEQ ID NO: 748
  Synthetic polypeptide

SEQ ID NO: 9845 - DNA, 2534 bp, Artificial Sequence
  Synthetic polypeptide
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9846 - DNA, 2174 bp, Artificial Sequence
  Synthetic polypeptide
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9847 - DNA, 491 bp, Artificial Sequence
  Synthetic polypeptide
aggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctga

SEQ ID NO: 9848 - DNA, 377 bp, Artificial Sequence
  Synthetic polypeptide
tctggcagtaagaggcctgctttccatcagggtagcaattccctggatttgagtaggagccgttccttttgcatggaacatggaccatctactttgctgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtag

SEQ ID NO: 9849 - DNA, 538 bp, Artificial Sequence
  Synthetic polypeptide
ctggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 9850 - DNA, 706 bp, Artificial Sequence
  Synthetic polypeptide
ctggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 9851 - DNA, 766 bp, Artificial Sequence
  Synthetic polypeptide
ctggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 9852 - DNA, 574 bp, Artificial Sequence
  Synthetic polypeptide
tggacaagtggcttatccaccctgaacttcagtttgctcatctataaaatgaggccattacaaatacccctaagacaaatggaaggattacaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatga

SEQ ID NO: 9853 - DNA, 2456 bp, Artificial Sequence
  Synthetic polypeptide
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9854 - DNA, 2328 bp, Artificial Sequence
  Synthetic polypeptide
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 9855 - DNA, 2096 bp, Artificial Sequence
  Synthetic polypeptide
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9856 - DNA, 798 bp, Artificial Sequence
  Synthetic polypeptide
ttatctgcagtttcactttctacgatttcagttacctatggtcaaatgtggtctgaaaatgttaagtacaaaattcaagaaataaacaatttataagttttaaattgcatgccgttctgagtagcatgatgaaatcttgtgctgtccagctctgtcccaacctggatgtgaatcatccctttgtccagcgtctccatgctgcagacactccctggcccattagtcacttactagccgcctcagtgatcgggtgttgtgatatcgcgtgcttattttcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtga

SEQ ID NO: 9857 - DNA, 1019 bp, Artificial Sequence
  Synthetic polypeptide
ttatctgcagtttcactttctacgatttcagttacctatggtcaaatgtggtctgaaaatgttaagtacaaaattcaagaaataaacaatttataagttttaaattgcatgccgttctgagtagcatgatgaaatcttgtgctgtccagctctgtcccaacctggatgtgaatcatccctttgtccagcgtctccatgctgcagacactccctggcccattagtcacttactagccgcctcagtgatcgggtgttgtgatatcgcgtgcttattttcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctga

SEQ ID NO: 9858 - DNA, 289 bp, Artificial Sequence
  Synthetic polypeptide
ttatctgcagtttcactttctacgatttcagttacctatggtcaaatgtggtctgaaaatgttaagtacaaaattcaagaaataaacaatttataagttttaaattgcatgccgttctgagtagcatgatgaaatcttgtgctgtccagctctgtcccaacctggatgtgaatcatccctttgtccagcgtctccatgctgcagacactccctggcccattagtcacttactagccgcctcagtgatcgggtgttgtgatatcgcgtgcttattttcagatgttgctga

SEQ ID NO: 9859 - DNA, 1175 bp, Artificial Sequence
  Synthetic polypeptide
tgcagatcctcaaagacctcatgctccccaggcctctggggccttgcacagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtga

SEQ ID NO: 9860 - DNA, 2216 bp, Artificial Sequence
  Synthetic polypeptide
tctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctga

SEQ ID NO: 9861 - DNA, 2249 bp, Artificial Sequence
  Synthetic polypeptide
tctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctga

SEQ ID NO: 9862 - DNA, 954 bp, Artificial Sequence
  Synthetic polypeptide
tctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagg

SEQ ID NO: 9863 - DNA, 796 bp, Artificial Sequence
  Synthetic polypeptide
tctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttgggga

SEQ ID NO: 9864 - DNA, 650 bp, Artificial Sequence; identical to SEQ ID NO: 9089
  Synthetic polypeptide

SEQ ID NO: 9865 - DNA, 1052 bp, Artificial Sequence; identical to SEQ ID NO: 9090
  Synthetic polypeptide

SEQ ID NO: 9866 - DNA, 3700 bp, Artificial Sequence
  Synthetic polypeptide
tgtggaggaaaacttaaatattaaatttgaactcaattgaacatggacacaaacaatggccaccaagtcccagaacaggtggtgtgagccccttgaggaattcatcgagcgctgtttcaaataaatctctatttaaattcctatttgttagttattgaaacacaacagacaatcgcaaacacaagttgacctttttgtgttccttgagtccagtcgggaagggcccttgtgactgggtctcatgccaaacaacttgttacgataagagctagggtcccagaccatgaggaaacttcatgagaatcctctgtagtctggtgagtgtagtgtccgactctggagcccaggctgttgcttcccggtgtggtggtgaatcctccacagtctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaacgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattcttactcctaa

SEQ ID NO: 9867 - DNA, 1042 bp, Artificial Sequence
  Synthetic polypeptide
tgtggaggaaaacttaaatattaaatttgaactcaattgaacatggacacaaacaatggccaccaagtcccagaacaggtggtgtgagccccttgaggaattcatcgagcgctgtttcaaataaatctctatttaaattcctatttgttagttattgaaacacaacagacaatcgcaaacacaagttgacctttttgtgttccttgagtccagtcgggaagggcccttgtgactgggtctcatgccaaacaacttgttacgataagagctagggtcccagaccatgaggaaacttcatgagaatcctctgtagtctggtgagtgtagtgtccgactctggagcccaggctgttgcttcccggtgtggtggtgaatcctccacagtctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggtaagttaa

SEQ ID NO: 9868 - DNA, 523 bp, Artificial Sequence
  Synthetic polypeptide
gaatgcattggatgagagggtaaaaatagaaagaaaaagaagtgatgactcctaggtcttggcatgtgtgggatataaacattcctttcaaattcagattattaaactagtgcagggcccatgcagttcccagcagccacatgcagctgtgacagggagcaccagcagctgaccagaggagctcataagcttttgccctgccctgctggtagttttaatttctgaagatcaaggagacaagaactgctaatctaatcaaggaagaactggtagttgaaacatgagagtgagaagctggatggaaaaattaaaagacaaggctggttacatgtctgggatgctggtgcctgtaggggttgggatagctggagccttgttcatcttgggagccctctacagcattaaggttatgaatcgccgaaggagaaatggcttcaaaaggcataaaagaaagcagagagaattcaacagcatgcaagatcgagtaatgctcttagccgacagctctgaagatgaattttga

SEQ ID NO: 9869 - DNA, 903 bp, Artificial Sequence
  Synthetic polypeptide
gctgtggacctgagcaagtctacacctgcgctaagcctcagcctcctcctcagcacaaaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagggtgccagacataggacctcaaaaacctctggtgcccaatgccctccgatgacttcagcaacctgcctgctggctgcacgtgtggctcttctctccgcagcgctggtgcgcgaagccaccgggcgcacagcccagcgctgtcgtctgagtccgcgggcggccgccgagcgcctgctggggccgccacctcacgttgcagcaggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctga

SEQ ID NO: 9870 - DNA, 714 bp, Artificial Sequence
  Synthetic polypeptide
gctgtggacctgagcaagtctacacctgcgctaagcctcagcctcctcctcagcacaaaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtga

SEQ ID NO: 9871 - DNA, 269 bp, Artificial Sequence
  Synthetic polypeptide
gctgtggacctgagcaagtctacacctgcgctaagcctcagcctcctcctcagcacaaaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactg

SEQ ID NO: 9872 - DNA, 884 bp, Artificial Sequence
  Synthetic polypeptide
gtggtggcatgggcctgtagtcctagctactctggaggctggagtgggaggattgcttgagcccaggagttcaaggctgcagtgagccatgattgtaccactacgctccagcctgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatga

SEQ ID NO: 9873 - DNA, 452 bp, Artificial Sequence
  Synthetic polypeptide
ccatcagctgctgtgtgaccttggccgaggccctctgcctgtctgggctctgacttcctctaacacgaagttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggtatttttcagtagatggaggtgctaggggtggacctgtgggcccttgccccccttcgcccccccctaggcggcccagggagcgctctccaggccccgtggacacgcgctcgcctgcctccagcggcaaggcccctcccagaggcggactcactggggccacctctccagcatggaccagaggagggaagcagggagagactgggtaa

SEQ ID NO: 9874 - DNA, 1208 bp, Artificial Sequence
  Synthetic polypeptide
ccatcagctgctgtgtgaccttggccgaggccctctgcctgtctgggctctgacttcctctaacacgaagttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggctagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgcctcggaccacagcagcagcggcaacgaccgcgactcggtgcgcagcggcgacagctcgggctcaggctccgggggcgcggcgcccgccttcccgccgccctccccgcccgcgccgcggcccaaggacggcgaggcgcgccggctgctgcagatggacagtggctacgccagcatcgagggccgcggcgcaggcgacgacaccgagccacctgccgcgcccgcccggccccgcagcccgcgcgcctggccccgccgcccgcgccgcgactacagcatcgacgagaagacggacgcgctgttccacgagttcctgcgccacgacccgcacttcgacgacacgccggctgccgcgcgacaccgcgcccgcgcgcacccgcacgcccgcaaacagtggcagcgtggccggcagcacagcgaccccggcgcccgcgcggccccggccctggccggaaccccggcaccgcctgccggcgcggcccgacccgcgcgtgcgcccttgcggcgcggcgacagcgtggacggcccgcccgacggtcgcaccctgggcggcgccggcgacgaccccgccatccccgtcatcgaggaggagccgggcggcggggggtgccccggctcgggcctgtgcgtcctaccatccgggtcggtgctggacaagctggcggctggcctcgacgagagactctttccgccgcgcctcgccgagcccgtcgtggcgactcccgcgttggtcgccgccgcccccacgtcccccgaccacagcccggcctaa

SEQ ID NO: 9875 - DNA, 1052 bp, Artificial Sequence; identical to SEQ ID NO: 447
  Synthetic polypeptide

SEQ ID NO: 9876 - DNA, 1118 bp, Artificial Sequence; identical to SEQ ID NO: 448
  Synthetic polypeptide

SEQ ID NO: 9877 - DNA, 906 bp, Artificial Sequence
  Synthetic polypeptide
tggtttgaatgtcccctccaaaactcatgctgaaacttcatccccagtgtggcagtattgagaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgaggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtag

SEQ ID NO: 9878 - DNA, 255 bp, Artificial Sequence
  Synthetic polypeptide
tggtttgaatgtcccctccaaaactcatgctgaaacttcatccccagtgtggcagtattgagaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgagccttga

SEQ ID NO: 9879 - DNA, 255 bp, Artificial Sequence
  Synthetic polypeptide
tggtttgaatgtcccctccaaaactcatgctgaaacttcatccccagtgtggcagtattgagaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgagccataa

SEQ ID NO: 9880 - DNA, 951 bp, Artificial Sequence
  Synthetic polypeptide
gaggtcatgggaacccagacactttcagatgctgatgtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9881 - DNA, 879 bp, Artificial Sequence
  Synthetic polypeptide
gaggtcatgggaacccagacactttcagatgctgatgtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9882 - DNA, 627 bp, Artificial Sequence
  Synthetic polypeptide
gaggtcatgggaacccagacactttcagatgctgatgtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9883 - DNA, 349 bp, Artificial Sequence
  Synthetic polypeptide
gaggtcatgggaacccagacactttcagatgctgatgtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaact

SEQ ID NO: 9884 - DNA, 2484 bp, Artificial Sequence
  Synthetic polypeptide
tttcttggttccctgaccgggaagcgaggtgactgacggccggcttaaacctgccctgtggagcgtccctgtgggggactccagacagcttgagtgacgcgatccaaagagtgctcccgggtaggcaattgccccagtggaacgcgtcgccagagcagcatgtagcaggcccccacagaggattaacacagtggctgaacaccaggaaggaactggcacttggagtccggacatctgaaacttgccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtga

SEQ ID NO: 9885 - DNA, 712 bp, Artificial Sequence
  Synthetic polypeptide
tatactcatgacggaatatgattcggccttaaaacaaaagggaatgctgatgtgggccgcagcttaggtggcctcagggacactctacagggagtaaaccagttgcagaggccccgtgccacgtgactccactgacgggaggttcccacaggagtcacattcattgagacaaaaagcagatggtgctggggcctggcgggggttgggggtcgggaggagttggcgtttcatgagggcagaatttcattttggaggatggagttctgaagatggacggtggtgacggttacacagtatgtgaatgtattgatacattatgaactctacacgtaaaaatggctaaaatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtag

SEQ ID NO: 9886 - DNA, 1295 bp, Artificial Sequence
  Synthetic polypeptide
gaaaaaaaagaaaagaaaaaaaattaaaccaaccacaacatcaccttaggttttggcattagctaaaaactaatacatagtaaagcgttaactattcaattgcatgaagcctcagagaggagaggaagatgcagaaaaaaagactgaagctagtagaggttgactaatgaggtttacaggaataaactgcctacatgatgcaaaagttcaatgtgaagcaataggaagtcatgcagaagacttagctaatatactcagtaaatgtggctacagtaaacaaatgattttcaatgtagacctaacagccttctgttggaagaagatgccatttaaaactttcatagctagagaagagaagtcaatgcttgtctttgaagctacaaaaaacaggctgaatctcttgtagtggctaatgcagctgatgacaaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatag

SEQ ID NO: 9887 - DNA, 632 bp, Artificial Sequence
  Synthetic polypeptide
gaaaaaaaagaaaagaaaaaaaattaaaccaaccacaacatcaccttaggttttggcattagctaaaaactaatacatagtaaagcgttaactattcaattgcatgaagcctcagagaggagaggaagatgcagaaaaaaagactgaagctagtagaggttgactaatgaggtttacaggaataaactgcctacatgatgcaaaagttcaatgtgaagcaataggaagtcatgcagaagacttagctaatatactcagtaaatgtggctacagtaaacaaatgattttcaatgtagacctaacagccttctgttggaagaagatgccatttaaaactttcatagctagagaagagaagtcaatgcttgtctttgaagctacaaaaaacaggctgaatctcttgtagtggctaatgcagctgatgacaaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaagttataccagaaaaccaagctctcttaagccatggcatctgtatctaaaatag

SEQ ID NO: 9888 - DNA, 638 bp, Artificial Sequence
  Synthetic polypeptide
ggctgggcgtggtggctcatgcctataatcccagcactttaggagggcaaggtggttggatcacctgaggtcaggagttcgagaccagtctggccaacaagattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 9889 - DNA, 943 bp, Artificial Sequence
  Synthetic polypeptide
tttcttggttccctgaacaggaagcgaggtaactgacggacggccaaggcagccccttgggtggcttaggcctgccctgtggagcatccctgcggtggactctggccagcctgagtgacgcgatccaaagagcgctcccgggtaggaaattccccgggtggaacgcctcgccagagcagcacgtagcaggcccccgaggaggattaacacactggctgaacactgggaaggaactggcacttggagtccggacatctgaaacttgtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactga

SEQ ID NO: 9890 - DNA, 694 bp, Artificial Sequence; identical to SEQ ID NO: 6465
  Synthetic polypeptide

SEQ ID NO: 9891 - DNA, 238 bp, Artificial Sequence; identical to SEQ ID NO: 6378
  Synthetic polypeptide

SEQ ID NO: 9892 - DNA, 416 bp, Artificial Sequence
  Synthetic polypeptide
taccaatttaaaaggacgaccagaagcagtttgcttttaccaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaa

SEQ ID NO: 9893 - DNA, 158 bp, Artificial Sequence; identical to SEQ ID NO: 7602
  Synthetic polypeptide

SEQ ID NO: 9894 - DNA, 1768 bp, Artificial Sequence
  Synthetic polypeptide
caacatagctaatcgagacagaatttgtgttttgtgcttcatggatcttttttacattcatgtccacttaaagaaggcagccagctccttcattcttttaacctcacaggaggtttgtgctgtaggacagaaaggctaattatccagcagatgatctgccttcctggcactccttgagggaattatgccagataggggaaagggagacatgtgccttgtggaaaagagaaggtgggaggggaggcatgccccagaagtccaggatgggaagagagatctgcagactcccagggaacctacagctttctccttcacagcattgcaggagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataa

SEQ ID NO: 9895 - DNA, 955 bp, Artificial Sequence
  Synthetic polypeptide
caacatagctaatcgagacagaatttgtgttttgtgcttcatggatcttttttacattcatgtccacttaaagaaggcagccagctccttcattcttttaacctcacaggaggtttgtgctgtaggacagaaaggctaattatccagcagatgatctgccttcctggcactccttgagggaattatgccagataggggaaagggagacatgtgccttgtggaaaagagaaggtgggaggggaggcatgccccagaagtccaggatgggaagagagatctgcagactcccagggaacctacagctttctccttcacagcattgcaggagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatggggccagtgttgtatag

SEQ ID NO: 9896 - DNA, 978 bp, Artificial Sequence
  Synthetic polypeptide
caacatagctaatcgagacagaatttgtgttttgtgcttcatggatcttttttacattcatgtccacttaaagaaggcagccagctccttcattcttttaacctcacaggaggtttgtgctgtaggacagaaaggctaattatccagcagatgatctgccttcctggcactccttgagggaattatgccagataggggaaagggagacatgtgccttgtggaaaagagaaggtgggaggggaggcatgccccagaagtccaggatgggaagagagatctgcagactcccagggaacctacagctttctccttcacagcattgcaggagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatat

SEQ ID NO: 9897 - DNA, 871 bp, Artificial Sequence
  Synthetic polypeptide
caacatagctaatcgagacagaatttgtgttttgtgcttcatggatcttttttacattcatgtccacttaaagaaggcagccagctccttcattcttttaacctcacaggaggtttgtgctgtaggacagaaaggctaattatccagcagatgatctgccttcctggcactccttgagggaattatgccagataggggaaagggagacatgtgccttgtggaaaagagaaggtgggaggggaggcatgccccagaagtccaggatgggaagagagatctgcagactcccagggaacctacagctttctccttcacagcattgcaggagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctc

SEQ ID NO: 9898 - DNA, 277 bp, Artificial Sequence
  Synthetic polypeptide
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattgatgcgctggctccctccctccgaggctacttctcagggctggaagtcccgtcagttctgctga

SEQ ID NO: 9899 - DNA, 406 bp, Artificial Sequence
  Synthetic polypeptide
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctga

SEQ ID NO: 9900 - DNA, 475 bp, Artificial Sequence
  Synthetic polypeptide
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttga

SEQ ID NO: 9901 - DNA, 430 bp, Artificial Sequence
  Synthetic polypeptide
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagctctgtgaaggtcagactgtgaggagaagccaccccttgagcgctccgtctcctgatagtgccagcctggcctggtttcctgtttga

SEQ ID NO: 9902 - DNA, 490 bp, Artificial Sequence
  Synthetic polypeptide
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctga

SEQ ID NO: 9903 - DNA, 247 bp, Artificial Sequence
  Synthetic polypeptide
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattaggtggagctaatgaacatggagagaggcagtga

SEQ ID NO: 9904 - DNA, 355 bp, Artificial Sequence
  Synthetic polypeptide
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggaaaccctgtag

SEQ ID NO: 9905 - DNA, 2309 bp, Artificial Sequence; identical to SEQ ID NO: 7608
  Synthetic polypeptide

SEQ ID NO: 9906 - DNA, 2389 bp, Artificial Sequence; identical to SEQ ID NO: 7609
  Synthetic polypeptide

SEQ ID NO: 9907 - DNA, 630 bp, Artificial Sequence
  Synthetic polypeptide
tgatatggtttggctgtgtccccacccagttctccaattgaatttaactcacataatccccacgtgtcatgggagggacccagtgggaggtaactgaatcatgggggcaggtttttcccgtgctgtacttgtgatagtgaataagtcttgtgagatctgatggttttgtaaagggcagttgtacatatgctgtcttgcctgccaccactaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggtaccaagtgctggtgtgattctaggatgtgcgaagagcccctggatgatggcgattggatttcccatctga

SEQ ID NO: 9908 - DNA, 711 bp, Artificial Sequence
  Synthetic polypeptide
tgatatggtttggctgtgtccccacccagttctccaattgaatttaactcacataatccccacgtgtcatgggagggacccagtgggaggtaactgaatcatgggggcaggtttttcccgtgctgtacttgtgatagtgaataagtcttgtgagatctgatggttttgtaaagggcagttgtacatatgctgtcttgcctgccaccactaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttag

SEQ ID NO: 9909 - DNA, 1926 bp, Artificial Sequence; identical to SEQ ID NO: 9669
  Synthetic polypeptide

SEQ ID NO: 9910 - DNA, 2439 bp, Artificial Sequence; identical to SEQ ID NO: 9670
  Synthetic polypeptide

SEQ ID NO: 9911 - DNA, 2481 bp, Artificial Sequence; identical to SEQ ID NO: 9671
  Synthetic polypeptide

SEQ ID NO: 9912 - DNA, 251 bp, Artificial Sequence
  Synthetic polypeptide
tgtggggaagagagaactggaccaggacagcgcgggaaactgacaatgccactgcttgctagctttgggattttggacaaataggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctga

SEQ ID NO: 9913 - DNA, 400 bp, Artificial Sequence; identical to SEQ ID NO: 749
  Synthetic polypeptide

SEQ ID NO: 9914 - DNA, 2301 bp, Artificial Sequence; identical to SEQ ID NO: 750
  Synthetic polypeptide

SEQ ID NO: 9915 - DNA, 2381 bp, Artificial Sequence; identical to SEQ ID NO: 751
  Synthetic polypeptide

SEQ ID NO: 9916 - DNA, 692 bp, Artificial Sequence; identical to SEQ ID NO: 752
  Synthetic polypeptide

SEQ ID NO: 9917 - DNA, 326 bp, Artificial Sequence
  Synthetic polypeptide
tatgtttaggctttgtgtccccacccaaatctcatcttgcattataatccccataatccccacgtgtcaagggaaagactgggtggaggtaattgtatcataggggcggtttcccccatgctgttcttgtgatagtaagtgagttctcatgagatccggtggttttataattgtttggttgttcctcatgcgttcgttctccttcctgctgcctgtgaagaaggtgccttgcttccccttcaccttccaccatgattgcaagtttcctgaggcctcctcagccatgcagaactacttcaaatcatcccaacaccagagaacactaa

SEQ ID NO: 9918 - DNA, 2152 bp, Artificial Sequence
  Synthetic polypeptide
tcatttctcaacctgttggactctttctgcagcatatggcaaagtggatctttctctccttcttgaaatgctccctgccttggctactttttagtctcctttgacgattcctcttcctctgcccatatttttaaatgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttag

SEQ ID NO: 9919 - DNA, 367 bp, Artificial Sequence
  Synthetic polypeptide
tcatttctcaacctgttggactctttctgcagcatatggcaaagtggatctttctctccttcttgaaatgctccctgccttggctactttttagtctcctttgacgattcctcttcctctgcccatatttttaaatgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggttagcatatgtttggaacaatga

SEQ ID NO: 9920 - DNA, 161 bp, Artificial Sequence; identical to SEQ ID NO: 7668
  Synthetic polypeptide

SEQ ID NO: 9921 - DNA, 178 bp, Artificial Sequence; identical to SEQ ID NO: 7669
  Synthetic polypeptide

SEQ ID NO: 9922 - DNA, 698 bp, Artificial Sequence
  Synthetic polypeptide
tgatatggtttggctgtgtccccacccagttctccaattgaatttaactcacataatccccacgtgtcatgggagggacccagtgggaggtaactgaatcatgggggcaggtttttcccgtgctgtacttgtgatagtgaataagtcttgtgagatctgatggttttgtaaagggcagttgtacatatgctgtcttgcctgccaccacgtaagtcatgcctttgctctttctttgtcttccaccgtgattgtgaggcctttccagcatgtggaacttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggtaccaagtgctggtgtgattctaggatgtgcgaagagcccctggatgatggcgattggatttcccatctga

SEQ ID NO: 9923 - DNA, 779 bp, Artificial Sequence
  Synthetic polypeptide
tgatatggtttggctgtgtccccacccagttctccaattgaatttaactcacataatccccacgtgtcatgggagggacccagtgggaggtaactgaatcatgggggcaggtttttcccgtgctgtacttgtgatagtgaataagtcttgtgagatctgatggttttgtaaagggcagttgtacatatgctgtcttgcctgccaccacgtaagtcatgcctttgctctttctttgtcttccaccgtgattgtgaggcctttccagcatgtggaacttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttag

SEQ ID NO: 9924 - DNA, 405 bp, Artificial Sequence
  Synthetic polypeptide
aaattgaggcaacaattaatagcctaccaaccaaaaatggtccaggaccagacggattcacagccaaattctaccagaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataa

SEQ ID NO: 9925 - DNA, 507 bp, Artificial Sequence
  Synthetic polypeptide
aaattgaggcaacaattaatagcctaccaaccaaaaatggtccaggaccagacggattcacagccaaattctaccagaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaa

SEQ ID NO: 9926 - DNA, 363 bp, Artificial Sequence; identical to SEQ ID NO: 7059
  Synthetic polypeptide

SEQ ID NO: 9927 - DNA, 465 bp, Artificial Sequence; identical to SEQ ID NO: 7060
  Synthetic polypeptide

SEQ ID NO: 9928 - DNA, 243 bp, Artificial Sequence; identical to SEQ ID NO: 6376
  Synthetic polypeptide

SEQ ID NO: 9929 - DNA, 877 bp, Artificial Sequence; identical to SEQ ID NO: 6377
  Synthetic polypeptide

SEQ ID NO: 9930 - DNA, 1133 bp, Artificial Sequence; identical to SEQ ID NO: 7332
  Synthetic polypeptide

SEQ ID NO: 9931 - DNA, 1172 bp, Artificial Sequence; identical to SEQ ID NO: 7333
  Synthetic polypeptide

SEQ ID NO: 9932 - DNA, 1178 bp, Artificial Sequence
  Synthetic polypeptide
cagcagacccttgaataatgttttgttataaaacattgatgagaaaaaaaagtatttcctggctggggccactgtctgttgggtttgcacgttctacccacgtctgcgtggctcttctgcaggcacccccacccacctacccacatcccaaacctgtgcctgtcaggttcatcagcacgtccgcatggtcccggtgtgggtgagtgtgggtgtgtgggcgtgtgtgccctgcgatgggagggcgtgctggccagggccggttcccgccttgttccctgagcagctgggatgggctctggccacccgtgacttggaactggaataagtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattga

SEQ ID NO: 9933 - DNA, 854 bp, Artificial Sequence
  Synthetic polypeptide
cagcagacccttgaataatgttttgttataaaacattgatgagaaaaaaaagtatttcctggctggggccactgtctgttgggtttgcacgttctacccacgtctgcgtggctcttctgcaggcacccccacccacctacccacatcccaaacctgtgcctgtcaggttcatcagcacgtccgcatggtcccggtgtgggtgagtgtgggtgtgtgggcgtgtgtgccctgcgatgggagggcgtgctggccagggccggttcccgccttgttccctgagcagctgggatgggctctggccacccgtgacttggaactggaataagtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacagg

SEQ ID NO: 9934 - DNA, 473 bp, Artificial Sequence
  Synthetic polypeptide
cagcagacccttgaataatgttttgttataaaacattgatgagaaaaaaaagtatttcctggctggggccactgtctgttgggtttgcacgttctacccacgtctgcgtggctcttctgcaggcacccccacccacctacccacatcccaaacctgtgcctgtcaggttcatcagcacgtccgcatggtcccggtgtgggtgagtgtgggtgtgtgggcgtgtgtgccctgcgatgggagggcgtgctggccagggccggttcccgccttgttccctgagcagctgggatgggctctggccacccgtgacttggaactggaataagtttgacatctacaggaaggtgcccaaggaccttacgcagccaacgtacaccggggccattatctccatctgctgctgcctcttcatcctcttcctcttcctctcggagctcaccggatttataacgacagaagttggttgggcttga

SEQ ID NO: 9935 - DNA, 722 bp, Artificial Sequence
  Synthetic polypeptide
cagcagacccttgaataatgttttgttataaaacattgatgagaaaaaaaagtatttcctggctggggccactgtctgttgggtttgcacgttctacccacgtctgcgtggctcttctgcaggcacccccacccacctacccacatcccaaacctgtgcctgtcaggttcatcagcacgtccgcatggtcccggtgtgggtgagtgtgggtgtgtgggcgtgtgtgccctgcgatgggagggcgtgctggccagggccggttcccgccttgttccctgagcagctgggatgggctctggccacccgtgacttggaactggaataagtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggaagttgaccagcagccagatgtcagagtttgcgtgttttga

SEQ ID NO: 9936 - DNA, 1067 bp, Artificial Sequence
  Synthetic polypeptide
tgatatggtttggctgtgtccccctccaaatctcaacttgaattgtatctcccggaattcccatgtgttgtgggagggacctgggaggaagtaattgaatcacgggggccggtctttcttgtactattcttgtgatagtgaataagtctcaggagatctgatgggtttatcaggggtttccgcttttgcttcttcctcatttttttctcttgctgctgccatgtaagaagtgcctttcgccacccactgtgattctgaggcttccccagccatgtggaactgtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtag

SEQ ID NO: 9937 - DNA, 968 bp, Artificial Sequence
  Synthetic polypeptide
tgatatggtttggctgtgtccccctccaaatctcaacttgaattgtatctcccggaattcccatgtgttgtgggagggacctgggaggaagtaattgaatcacgggggccggtctttcttgtactattcttgtgatagtgaataagtctcaggagatctgatgggtttatcaggggtttccgcttttgcttcttcctcatttttttctcttgctgctgccatgtaagaagtgcctttcgccacccactgtgattctgaggcttccccagccatgtggaactgtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggattactatga

SEQ ID NO: 9938 - DNA, 558 bp, Artificial Sequence
  Synthetic polypeptide
ggccgggcgcggtggctcacacctgtaattccagcactttgggaggccgaggcgggtggatcacctgaggtcaggagttcaagaccagcctgggcaacatggagaaaccctgtctctacaaaaatacaaaaattagccagagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccagacgaggtcttgctatgttgaccaggctggtcttgaactcctggccttaa

SEQ ID NO: 9939 - DNA, 837 bp, Artificial Sequence
  Synthetic polypeptide
ggccgggcgcggtggctcacacctgtaattccagcactttgggaggccgaggcgggtggatcacctgaggtcaggagttcaagaccagcctgggcaacatggagaaaccctgtctctacaaaaatacaaaaattagccagagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagaggatattcaaaagtacacctgccgagtcccagccctga

SEQ ID NO: 9940 - DNA, 876 bp, Artificial Sequence
  Synthetic polypeptide
ggccgggcgcggtggctcacacctgtaattccagcactttgggaggccgaggcgggtggatcacctgaggtcaggagttcaagaccagcctgggcaacatggagaaaccctgtctctacaaaaatacaaaaattagccagagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtga

SEQ ID NO: 9941 - DNA, 767 bp, Artificial Sequence
  Synthetic polypeptide
catgcctacaatcccagcactttgggaggctaagacaggcagatcgcttgagttcaggagtttgagattagcctgggcaacatggcgaaaccctaaaaaacacaaaaattagctgggcatggtggcttgttcctagagtcctagctactcgggaggctgagaaaaagaagcaaaaaaagttgaaggatttgatctggttcagaagccaactccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 9942 - DNA, 880 bp, Artificial Sequence
  Synthetic polypeptide
catgcctacaatcccagcactttgggaggctaagacaggcagatcgcttgagttcaggagtttgagattagcctgggcaacatggcgaaaccctaaaaaacacaaaaattagctgggcatggtggcttgttcctagagtcctagctactcgggaggctgagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 9943 - DNA, 182 bp, Artificial Sequence
  Synthetic polypeptide
cttgcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctggtg

SEQ ID NO: 9944 - DNA, 1977 bp, Artificial Sequence
  Synthetic polypeptide
cttgcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagc

SEQ ID NO: 9945 - DNA, 1269 bp, Artificial Sequence
  Synthetic polypeptide
cttgcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacg

SEQ ID NO: 9946 - DNA, 1169 bp, Artificial Sequence
  Synthetic polypeptide
cttgcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggatgggaacaaacagaataccaatagccagtcaattggaagcatctcaggtggcctggaggatcaatatacctggccagacacacactggccttcccaaagttag

SEQ ID NO: 9947 - DNA, 1266 bp, Artificial Sequence
  Synthetic polypeptide
acatttctactcacaggtctcagagcacttcaaactcagtgtgtccaaaacagagctaccatctgctccagatctgctttatttctggtattcttagctccttgaatggcaccatcatataataaattggacaagccagaacctggaagtcaatttgtcctttccctctctgtcatgttccatatctaacttaacatcaagctctgtccattttacttcctgacttcctctgtaacccatttcttcccgtgtttaccatcacctggtctcagctacccctgtctccctcctgactggcctcccacttccactcttgcccctccactcaattcttctctgttctgcagcccaagtgaccctctcaaaatgtaaatctgatcatgtcactctcctccttagtgctccctagtgactctccagagcttttggaatgaaaagcaaaattcctgtcatggtccacaaagccctgcctagtctggctctgccaacctatttccccacaatccagccacgttggctctctcctcctgtgtttcctgccaccacgtggcctttgcacttgcggtttcctcttactggaatttcctcccgccctccctgcttgcttcagtctggttaactcctacgtatttatcctctatatctctgcttgcccgactcctttttggaggagcttttcctgatcctctaggtcaaggggagctcccaacatctccccattagtgccatgctcctttccttccttgcatttgtcagttttaatttccactcctatgagtgatcactgggttaatgctttctcccgccacccacccgtctacaatctccatgagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtga

SEQ ID NO: 9948 - DNA, 2046 bp, Artificial Sequence
  Synthetic polypeptide
tggtgtggtctgaatgtttgtatcccccaaaattcataggttgaaatctctctccaatgaaatggtactaaaggtggggcctttaggaggcgattaggtcatgattgcaaagccctcgtgagtgggattcatgcctttatgaaggaggccctgggggcttcttcacccttttggccatgtgaagacacagctggaaggcaccatctaggaagcatggagccggcaccagacactgaatctgctaccaccttgatcttggacttcccagccttcagacctgtgggagatagaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttga

SEQ ID NO: 9949 - DNA, 1965 bp, Artificial Sequence; identical to SEQ ID NO: 8289
  Synthetic polypeptide

SEQ ID NO: 9950 - DNA, 857 bp, Artificial Sequence
  Synthetic polypeptide
acccggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtag

SEQ ID NO: 9951 - DNA, 824 bp, Artificial Sequence
  Synthetic polypeptide
acccggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgatggagttttgctctgttgcccaggctggagtgcaatggtgccatctcagctcactgcaacctctgccgcttgggttgaagcgattatcctgtctaagcctcccgagtaactga

SEQ ID NO: 9952 - DNA, 514 bp, Artificial Sequence
  Synthetic polypeptide
acccggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttccc

SEQ ID NO: 9953 - DNA, 1543 bp, Artificial Sequence; identical to SEQ ID NO: 8010
  Synthetic polypeptide

SEQ ID NO: 9954 - DNA, 772 bp, Artificial Sequence; identical to SEQ ID NO: 8011
  Synthetic polypeptide

SEQ ID NO: 9955 - DNA, 608 bp, Artificial Sequence; identical to SEQ ID NO: 8012
  Synthetic polypeptide

SEQ ID NO: 9956 - DNA, 535 bp, Artificial Sequence; identical to SEQ ID NO: 8013
  Synthetic polypeptide

SEQ ID NO: 9957 - DNA, 454 bp, Artificial Sequence; identical to SEQ ID NO: 8014
  Synthetic polypeptide

SEQ ID NO: 9958 - DNA, 280 bp, Artificial Sequence; identical to SEQ ID NO: 8015
  Synthetic polypeptide

SEQ ID NO: 9959 - DNA, 1681 bp, Artificial Sequence; identical to SEQ ID NO: 714
  Synthetic polypeptide

SEQ ID NO: 9960 - DNA, 1543 bp, Artificial Sequence; identical to SEQ ID NO: 717
  Synthetic polypeptide

SEQ ID NO: 9961 - DNA, 258 bp, Artificial Sequence; identical to SEQ ID NO: 719
  Synthetic polypeptide

SEQ ID NO: 9962 - DNA, 763 bp, Artificial Sequence; identical to SEQ ID NO: 606
  Synthetic polypeptide

SEQ ID NO: 9963 - DNA, 2231 bp, Artificial Sequence
  Synthetic polypeptide
ggagcatagtggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaa

SEQ ID NO: 9964 - DNA, 916 bp, Artificial Sequence; identical to SEQ ID NO: 7516
  Synthetic polypeptide

SEQ ID NO: 9965 - DNA, 157 bp, Artificial Sequence; identical to SEQ ID NO: 7517
  Synthetic polypeptide

SEQ ID NO: 9966 - DNA, 424 bp, Artificial Sequence; identical to SEQ ID NO: 7518
  Synthetic polypeptide

SEQ ID NO: 9967 - DNA, 675 bp, Artificial Sequence; identical to SEQ ID NO: 7519
  Synthetic polypeptide

SEQ ID NO: 9968 - DNA, 1447 bp, Artificial Sequence
  Synthetic polypeptide
gaacttggaaagaatcccaaggagaaagaaaatgttgagttgaaaaacaatgaggatgaaaaattagaattattcaacttaaaggacaaaaggctgaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtggacaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccatgcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctag

SEQ ID NO: 9969 - DNA, 1828 bp, Artificial Sequence
  Synthetic polypeptide
gaacttggaaagaatcccaaggagaaagaaaatgttgagttgaaaaacaatgaggatgaaaaattagaattattcaacttaaaggacaaaaggctgaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtggacaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccatgcggaggcgctcatccaccccacgggactgagcacgggggctctggttgccatccttctgtgcatcgtgatcctactagtgacagtggtgctgtttgcagctctgaggcggcagcgaaaaaaagagcctttgatcatttccaaagaggacatcagagataacattgtcagttacaacgacgaaggtggtggagaggaggacacccaggcttttgatatcggcaccctgaggaatcctgaagccatagaggacaacaaattacgaagggacattgtgcccgaagcccttttcctaccccgacggactccaacagctcgcgacaacaccgatgtcagagatttcattaaccaaaggttaaaggaaaatgacacggaccccactgccccgccatacgactccttggccacttacgcctatgaaggcactggctccgtggcggattccctgagctcgctggagtcagtgaccacggatgcagatcaagactatgattaccttagtgactggggacctcgattcaaaaagcttgcagatatgtatggaggagtggacagtgacaaagactcctaa

SEQ ID NO: 9970 - DNA, 616 bp, Artificial Sequence
  Synthetic polypeptide
ccttcctcttggtcctctgactctgcccacctccttccttttgtcccccgctgccaacgtcatcctctccaattccgctccctctcctccccagccctcaccttggagcctcccatgaggggccttgcttgctcttgattttgtgactgtgatcatctctgccccatgcacacattttatttcccatgtgagactgctcagatacttttttgtcttctccttgcatcctctgagagcactggacacagtgccagacacagagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttga

SEQ ID NO: 9971 - DNA, 1084 bp, Artificial Sequence; identical to SEQ ID NO: 580
  Synthetic polypeptide

SEQ ID NO: 9972 - DNA, 773 bp, Artificial Sequence
  Synthetic polypeptide
ttatctgattgaaaattagcaaagatctgaatagacatttctcaaagaagagataagaatggacaacaggcatatgaaaaatactcaacaccactaattattagggaaatacaaaccaaaaccacaatgagatatcacctcatcccagttaaaatggctattatcaaaaagacagtaagaatgttgataaaggggcaatgcttatacactgttgttgggaatgtagatcagccactatggaaaacagtatggagattcctcaaaaaacttaaaatagaactaccatatgatgcaataatcccattgcagtgtatatatccaaaagaaagaaaatcagtatatcaaagagttatctgtgcttccatgtttattacagcactagttacaatagacaagatttggaatcaacctgtgttcatcaatggatgaatggataaagaaaatgtggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataa

SEQ ID NO: 9973 - DNA, 875 bp, Artificial Sequence
  Synthetic polypeptide
ttatctgattgaaaattagcaaagatctgaatagacatttctcaaagaagagataagaatggacaacaggcatatgaaaaatactcaacaccactaattattagggaaatacaaaccaaaaccacaatgagatatcacctcatcccagttaaaatggctattatcaaaaagacagtaagaatgttgataaaggggcaatgcttatacactgttgttgggaatgtagatcagccactatggaaaacagtatggagattcctcaaaaaacttaaaatagaactaccatatgatgcaataatcccattgcagtgtatatatccaaaagaaagaaaatcagtatatcaaagagttatctgtgcttccatgtttattacagcactagttacaatagacaagatttggaatcaacctgtgttcatcaatggatgaatggataaagaaaatgtggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaa

SEQ ID NO: 9974 - DNA, 1747 bp, Artificial Sequence
  Synthetic polypeptide
tcttcctctgagcacactggaagattacagttcccagcttccttgcagttaggtaggatcatgtgattagttctagccaatgacgtggaagtgatgggtattatttcctggtcaagacattaggagctagtgtgccacttgcattctttccctttccctgccacagtgactttgggggccttgtgtttcagatggtggggtctccattgggctgatccaggaaggactgagtggagtagagtccattcccttcccccatcaacatattagacagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctag

SEQ ID NO: 9975 - DNA, 442 bp, Artificial Sequence
  Synthetic polypeptide
tcttcctctgagcacactggaagattacagttcccagcttccttgcagttaggtaggatcatgtgattagttctagccaatgacgtggaagtgatgggtattatttcctggtcaagacattaggagctagtgtgccacttgcattctttccctttccctgccacagtgactttgggggccttgtgtttcagatggtggggtctccattgggctgatccaggaaggactgagtggagtagagtccattcccttcccccatcaacatattagacagaaactgaggcttcttgaagagcttgaagacacttggctcccttatctgacccccaaagatgatgaattctatcagcaggccctgaagaggaaagtgaggatgactctcatctcgaaggcagggatcctgatatttggcatgttggttttaagatctcatgggacatag

SEQ ID NO: 9976 - DNA, 251 bp, Artificial Sequence
  Synthetic polypeptide
ggccaggcgcagtgggtcatacctgtaatcccagcactttgggaggctgaggagggtggatcacatgaggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctag

SEQ ID NO: 9977 - DNA, 5350 bp, Artificial Sequence; identical to SEQ ID NO: 655
  Synthetic polypeptide

SEQ ID NO: 9978 - DNA, 302 bp, Artificial Sequence
  Synthetic polypeptide
ggaagattgtgttggctccttttctggaaaactttagaaacttgacagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctga

SEQ ID NO: 9979 - DNA, 440 bp, Artificial Sequence
  Synthetic polypeptide
gtgcaatcccttgccctgtggctgctggttaggtttggtttaaggggatctctagcagacaatcataggaggaagagaaaaggaagaagtctgggtgcttattcactggcttccttactgcaagttaccctcaggctggctgcattgccttgctgaagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcag

SEQ ID NO: 9980 - DNA, 197 bp, Artificial Sequence
  Synthetic polypeptide
gtgcaatcccttgccctgtggctgctggttaggtttggtttaaggggatctctagcagacaatcataggaggaagagaaaaggaagaagtctgggtgcttattcactggcttccttactgcaagttaccctcaggctggctgcattgccttgctgaagcactgggttctaatcttcacgtcgaagtgaagggttatg

SEQ ID NO: 9981 - DNA, 730 bp, Artificial Sequence
  Synthetic polypeptide
gtgcaatcccttgccctgtggctgctggttaggtttggtttaaggggatctctagcagacaatcataggaggaagagaaaaggaagaagtctgggtgcttattcactggcttccttactgcaagttaccctcaggctggctgcattgccttgctgaagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctga

SEQ ID NO: 9982 - DNA, 2380 bp, Artificial Sequence
  Synthetic polypeptide
tttcttggtttcctgaccgggaagcgaggtgattggcagatgattgaggcagccccttaggcgacttaggcctgtcctgtagagcatccctgtgggggactcagaccagcctgggcaacgcagatccaaagagtgctcccaggtaggcaattgccccagtgggatgccttgccagagcagcatggggcaggcccctgctgaggatcaactcagtggctgaacactgagaaggaactgacatttggagtccagacatctgaagtttgggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtga

SEQ ID NO: 9983 - DNA, 358 bp, Artificial Sequence
  Synthetic polypeptide
gaataaggaagactgagttttagttctacctgtgtcaggaatgtgtgaaatgtcacttaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctga

SEQ ID NO: 9984 - DNA, 358 bp, Artificial Sequence
  Synthetic polypeptide
gaataaggaagactgagttttagttctacctgtgtcaggaatgtgtgaaatgtcacttaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaa

SEQ ID NO: 9985 - DNA, 952 bp, Artificial Sequence; identical to SEQ ID NO: 8583
  Synthetic polypeptide

SEQ ID NO: 9986 - DNA, 87 bp, Artificial Sequence; identical to SEQ ID NO: 8584
  Synthetic polypeptide

SEQ ID NO: 9987 - DNA, 233 bp, Artificial Sequence
  Synthetic polypeptide
attccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaaga

SEQ ID NO: 9988 - DNA, 585 bp, Artificial Sequence
  Synthetic polypeptide
attccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataa

SEQ ID NO: 9989 - DNA, 342 bp, Artificial Sequence
  Synthetic polypeptide
attccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaa

SEQ ID NO: 9990 - DNA, 346 bp, Artificial Sequence
  Synthetic polypeptide
attccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaa

SEQ ID NO: 9991 - DNA, 504 bp, Artificial Sequence; identical to SEQ ID NO: 7011
  Synthetic polypeptide

SEQ ID NO: 9992 - DNA, 2153 bp, Artificial Sequence; identical to SEQ ID NO: 7012
  Synthetic polypeptide

SEQ ID NO: 9993 - DNA, 818 bp, Artificial Sequence; identical to SEQ ID NO: 7013
  Synthetic polypeptide

SEQ ID NO: 9994 - DNA, 176 bp, Artificial Sequence
  Synthetic polypeptide
ggctgggcacagtggctcacgcctgtaataccaacactttgggaggccgaggcgggtggatcacttggtcaagagatcgacaccatcctggataacacgattacgatgaggacctggtgcaggaagcttcatctgaagatgtcctgggcgttcatatgtgttttgtttttctctaa

SEQ ID NO: 9995 - DNA, 100 bp, Artificial Sequence
  Synthetic polypeptide
ggctgggcacagtggctcacgcctgtaataccaacactttgggaggccgaggcgggtggatcacttggtcaagagatcgacaccatcctggataacacga

SEQ ID NO: 9996 - DNA, 426 bp, Artificial Sequence
  Synthetic polypeptide
ggctgggcacagtggctcacgcctgtaataccaacactttgggaggccgaggcgggtggatcacttggtcaagagatcgacaccatcctggataacacgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctg

SEQ ID NO: 9997 - DNA, 1024 bp, Artificial Sequence; identical to SEQ ID NO: 794
  Synthetic polypeptide

SEQ ID NO: 9998 - DNA, 607 bp, Artificial Sequence
  Synthetic polypeptide
agaggcaacgtgttacagcaggttccggtgttcctcctgccagcgaagttgggcttccgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcacgaggaagtctccagaaatgccagtaatcctggaagtgtccctggaaggatcccatgacacagccaattgtgaggcatgcactttgggcatctgtggacagggcttaaaaagctgcatgacaaagccgtccaaatccctactcccccacctaaagactgggaattcctcacctggaattggtgctgtgtacctcgcaaaccaagccaagaaccagtcagctgaggcaaaagaggctaaggggagtgggtatgagaaattagggcccagtcgagacccagatccactgaacatctgtgtctttattttgctgcttgtatttattgtagtcaaatgctttacatcagaatga

SEQ ID NO: 9999 - DNA, 452 bp, Artificial Sequence
  Synthetic polypeptide
ggctgggcacagtggctcacgcctgtaataccaacactttgggaggccgaggcgggtggatcacttggtcaagagatcgacaccatcctggataacacgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgca

SEQ ID NO: 10000 - DNA, 590 bp, Artificial Sequence
  Synthetic polypeptide
ggctgggcacagtggctcacgcctgtaataccaacactttgggaggccgaggcgggtggatcacttggtcaagagatcgacaccatcctggataacacgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttag

SEQ ID NO: 10001 - DNA, 1615 bp, Artificial Sequence
  Synthetic polypeptide
tcctggttccctgaccaggaagtgagttgactgagggagggccgaggcagccccttaggctacttaagcctgccctgtggggcatccctgcgggggactctgaccagcctgagtgacgccttccaaagagcgctcccgggtgggaaattgtcctggtggaacgcctcaccagagcaacaggtagcaggcccccgcggaggattaacacagtggctgaacaccgggaaggaactggcacttggagtccggacatctgaaacttggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtag

SEQ ID NO: 10002 - DNA, 694 bp, Artificial Sequence
  Synthetic polypeptide
tcctggttccctgaccaggaagtgagttgactgagggagggccgaggcagccccttaggctacttaagcctgccctgtggggcatccctgcgggggactctgaccagcctgagtgacgccttccaaagagcgctcccgggtgggaaattgtcctggtggaacgcctcaccagagcaacaggtagcaggcccccgcggaggattaacacagtggctgaacaccgggaaggaactggcacttggagtccggacatctgaaacttggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtag

SEQ ID NO: 10003 - DNA, 443 bp, Artificial Sequence
  Synthetic polypeptide
tgcctggattggagtcctgacctggctactcccagctgtgtgaactgggccagcaacttagctccgttgtgcctcagtttctccatctctaaatgaagcgcttattcctctctcatggagccgtcgtgagaattacgtgaatgaatacaggctgactactttgaacagtgcctgatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaa

SEQ ID NO: 10004 - DNA, 713 bp, Artificial Sequence
  Synthetic polypeptide
ggctgggcgtggtggctcatgcctataatcccagcactttaggagggcaaggtggttggatcacctgaggtcaggagttcgagaccagtctggccaacaaggtgaaatcctgtctctactaaaaatacaaaaattagctgggcatggtggcgtatgcctgtaatcccagctactcgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 10005 - DNA, 560 bp, Artificial Sequence
  Synthetic polypeptide
gtgtcacctgtcactccctggacggcaagtgccagctgaaggtgagaagcaacacctgttactgctgtgacctctatgcctgcgggagcgcagagccctcgcccgcctactatgagttcatcggcgtcagcggctgccaggacgtgctgcacctgtaccgcctgctctgggcctctgcagttctgaacgtcctgggcctgttcctgggcatcatcaccgccgccgtcctgggggccttcaaggacatggtgcctctgtcccagctggcctatggcccagccgtcccaccacagaccctctacaaccccgcccagcagatcctggcctacgcaggcttccgcctgacgcccgagcccgtcccgacctgctcgtcctaccctctgccccttcagccctgcagccgcttcccagttgcgccctcctctgccctggcttcgtctgaggacctgcagcccccttctccaagcagctctggctctgggcttcccggccaggctccaccgtgctacgcacccacctactttcccccgggggagaagccacccccctacgcaccctga

SEQ ID NO: 10006 - DNA, 2436 bp, Artificial Sequence
  Synthetic polypeptide
acattcattttactagaagatcacagaagttaaagacttaaaaaaaactttggcaattaagacagcataccaagatgcaaatgcctggttgaaatagatcaaatattccatctgcacgttaaacaaaagcaattgttatgcttgtgcacatggcaggccagaggccctaattgtcccctttccactacagtggtcctccagttgaccaggcgtaggctgcatggtaactcttttccaggattctacagcctggagtaataagtcatgccaagctctctctgctatatcctgaagtccctgtgggtcagcctccgagggccatccagcttccatctcccaacactaagttcacttcgtgtctctcacagcagggaggagacagcattccttagagacctgaaaggatgcagtgagcttaagaattttcgaaaggttatcaatcagtcagccgttgttcatccccgagcagatgtgtggtggtattgtggtggacctttactaggtactctgctgaataagtagagtggcacttgtgctttagtccatttggctatccctttcatcctggcatttcatcaaccagaggaagaaaagaaaataataagatatcataaagcgagagaagccccttataggtcttccaactctcatatctatttagatgcaattagagccccgcaaggaataccagatcaatttaaagcttgaaatcaaatagctacaggatttaagtcaatattttggtagatgacagtgaataaaaatgtagattagataaactacatctattacaaccaacagcaaagagcttttcatgagttaaaaaaaaaaaaactcatgtcggccccagccctgaggttacctgacctgactctgtgaagtctgtgtgtcagaaaagaaaaaaatggcagttggagttttaactcagactgtggggcactggccaaggccagtggcctatctctcaaaacaaaaagacagggtttccaaaggctggcccccatgtccaagggccctggcagcaatggccctgttaccacaagaagcagataagctaactcttagacaaaacctaaacataaagtctccccatgctgtggtgattttaataaatactaaaggacaccattagctaataaatgttacactaagtagataccaaagcttgctctgtgaaaatccccacataaccattgaagtttgcaacaccctaaccctgccaccttactcctggtatcagagagcctagttaaacataactgtttagaggtgctggactcagtttattctagtaggcccaacctccgagacaatccttaaccatcagtagactaggagttgtatgtagataggagcagcgtcaccaacccctgcaaagtgactctgaagaagactacaagccctgctccagtcacacccagaagctgactggtccacgcacggctgaagcatgaggaaactcatcgcaggactcattttccttaaaatttggacttgtacattaaggacttcagctgaacttcctcagactgagggctgttcccagtatatacatcaagtcactgaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctctacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattag

SEQ ID NO: 10007 - DNA, 1956 bp, Artificial Sequence
  Synthetic polypeptide
acattcattttactagaagatcacagaagttaaagacttaaaaaaaactttggcaattaagacagcataccaagatgcaaatgcctggttgaaatagatcaaatattccatctgcacgttaaacaaaagcaattgttatgcttgtgcacatggcaggccagaggccctaattgtcccctttccactacagtggtcctccagttgaccaggcgtaggctgcatggtaactcttttccaggattctacagcctggagtaataagtcatgccaagctctctctgctatatcctgaagtccctgtgggtcagcctccgagggccatccagcttccatctcccaacactaagttcacttcgtgtctctcacagcagggaggagacagcattccttagagacctgaaaggatgcagtgagcttaagaattttcgaaaggttatcaatcagtcagccgttgttcatccccgagcagatgtgtggtggtattgtggtggacctttactaggtactctgctgaataagtagagtggcacttgtgctttagtccatttggctatccctttcatcctggcatttcatcaaccagaggaagaaaagaaaataataagatatcataaagcgagagaagccccttataggtcttccaactctcatatctatttagatgcaattagagccccgcaaggaataccagatcaatttaaagcttgaaatcaaatagctacaggatttaagtcaatattttggtagatgacagtgaataaaaatgtagattagataaactacatctattacaaccaacagcaaagagcttttcatgagttaaaaaaaaaaaaactcatgtcggccccagccctgaggttacctgacctgactctgtgaagtctgtgtgtcagaaaagaaaaaaatggcagttggagttttaactcagactgtggggcactggccaaggccagtggcctatctctcaaaacaaaaagacagggtttccaaaggctggcccccatgtccaagggccctggcagcaatggccctgttaccacaagaagcagataagctaactcttagacaaaacctaaacataaagtctccccatgctgtggtgattttaataaatactaaaggacaccattagctaataaatgttacactaagtagataccaaagcttgctctgtgaaaatccccacataaccattgaagtttgcaacaccctaaccctgccaccttactcctggtatcagagagcctagttaaacataactgtttagaggtgctggactcagtttattctagtaggcccaacctccgagacaatccttaaccatcagtagactaggagttgtatgtagataggagcagcgtcaccaacccctgcaaagtgactctgaagaagactacaagccctgctccagtcacacccagaagctgactggtccacgcacggctgaagcatgaggaaactcatcgcaggactcattttccttaaaatttggacttgtacattaaggacttcagctgaacttcctcagactgagggctgttcccagtatatacatcaagtcactgaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctctacaagtggataccccagaatgaccttctagatataaagagaatgttatga

SEQ ID NO: 10008 - DNA, 2356 bp, Artificial Sequence
  Synthetic polypeptide
caggttgagcaccctgaatccgaaaatccaaaaccgaaaactttttgaatgctgagttgacactctgcaggtgatgggctgcagtcaaaacacagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctga

SEQ ID NO: 10009 - DNA, 871 bp, Artificial Sequence
  Synthetic polypeptide
caggttgagcaccctgaatccgaaaatccaaaaccgaaaactttttgaatgctgagttgacactctgcaggtgatgggctgcagtcaaaacacagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagccgtgcatctgcagctggggtctgatgtctcctgaaagtaaagcagaattttgtgtgtgcgtctgtcggatttctctggggagacagtgtgttcatctttctgggctttga

SEQ ID NO: 10010 - DNA, 2470 bp, Artificial Sequence
  Synthetic polypeptide
caggttgagcaccctgaatccgaaaatccaaaaccgaaaactttttgaatgctgagttgacactctgcaggtgatgggctgcagtcaaaacacagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagttgactttccaagtgcgacactcgtgtgtgtaggcacagtgcagatgtacgcacacacacacctccggcttggggccccaggcccgcactgtgctcacggatctgctctgcccaggttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctga

SEQ ID NO: 10011 - DNA, 1088 bp, Artificial Sequence
  Synthetic polypeptide
ggctgggcacagtggctcacgcctgtaataccaacacttttggaggccgaggcaggtggatcacttggtcaagagatcgacaccatcctggataacacgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttag

SEQ ID NO: 10012 - DNA, 696 bp, Artificial Sequence; identical to SEQ ID NO: 6897
  Synthetic polypeptide

SEQ ID NO: 10013 - DNA, 801 bp, Artificial Sequence; identical to SEQ ID NO: 6898
  Synthetic polypeptide

SEQ ID NO: 10014 - DNA, 1206 bp, Artificial Sequence; identical to SEQ ID NO: 7670
  Synthetic polypeptide

SEQ ID NO: 10015 - DNA, 1134 bp, Artificial Sequence; identical to SEQ ID NO: 7671
  Synthetic polypeptide

SEQ ID NO: 10016 - DNA, 1002 bp, Artificial Sequence; identical to SEQ ID NO: 7672
  Synthetic polypeptide

SEQ ID NO: 10017 - DNA, 634 bp, Artificial Sequence; identical to SEQ ID NO: 7103
  Synthetic polypeptide

SEQ ID NO: 10018 - DNA, 535 bp, Artificial Sequence
  Synthetic polypeptide
gtgcagccaatttggaaaatttgccagcatttccccaagaagtatacataaagttaccattggacccaacacttccactcccaggacaggagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctga

SEQ ID NO: 10019 - DNA, 925 bp, Artificial Sequence
  Synthetic polypeptide
gcaatggctcacacatataatctcagaccttttggaagaccaaggcaggaggattgcttgaggccaagagttcgagaccaagcctgggcaacatatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 10020 - DNA, 252 bp, Artificial Sequence
  Synthetic polypeptide
gcaatggctcacacatataatctcagaccttttggaagaccaaggcaggaggattgcttgaggccaagagttcgagaccaagcctgggcaacatatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgc

SEQ ID NO: 10021 - DNA, 184 bp, Artificial Sequence
  Synthetic polypeptide
gcaatggctcacacatataatctcagaccttttggaagaccaaggcaggaggattgcttgaggccaagagttcgagaccaagcctgggcaacatatggaaatcctgactgctcgtcagaagaaagcagaagaactaaagagactcactgaccttgccagtcagatggcagagatgcagctggcc

SEQ ID NO: 10022 - DNA, 480 bp, Artificial Sequence
  Synthetic polypeptide
gtggttctctgtggtccctggataagaggcatcaccattatctggaaacatgcagtaaatgcagattcttcatcttctccccagacctcctgagttagaaattcacaagttctccaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactga

SEQ ID NO: 10023 - DNA, 351 bp, Artificial Sequence
  Synthetic polypeptide
gtggttctctgtggtccctggataagaggcatcaccattatctggaaacatgcagtaaatgcagattcttcatcttctccccagacctcctgagttagaaattcacaagttctccaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaa

SEQ ID NO: 10024 - DNA, 2245 bp, Artificial Sequence
  Synthetic polypeptide
acattcattttactagaggatcatagaagttaaagacttaaaacaaactttggcagttaagacagcataccaagatgcaaatgcctggttggaatggattaaatattccatctgcacgttaaacaaaatcaattgttatgcttgtgcacatggcaggccagaggccctgattgtccctcttccactaaggtggtcctccagtcgaccaggtgtgggctgcatggtagctcttttccaggattctacagcctggagtaataagtcatgccaagctctctctgctatatcccgaagtctctgtgggtcagcccccgagggccatccagcttccatctcccaacactaagttcacttcttgtctctcacggcagggaggagatttagcattccttggagacctgaagggatgcagtgagcttaagagtttccaagagcttatcaatcagtcagcccttgttcatccccgagaggatgtgtggtggtatcggggtggacctttactgggcactctgctgaataactagagtggcacttgtgctttagtccatttggctatccctttcaccctggcatttcatcaaccagaggaaaaaaaaagtaagacatcataaaacgagagaagccccttataggtctttcaattctcacatctacttaaatgcaattggagccccacaaggaataccagatcaatttaaagcttgaaatcaaatagttacaggatttaagtcaatattttagtagatgacagtcaacaaaaatgtagattagataaactacatctattacaaccaacagcaaagagcttttcattagttaaaaagaaaaactcatgtcggccccagccctgaggctacctgacctgacaaaactctttacactctgtgtgtcagaaagagaaaaaatgacagttggagttttaacccagactgtagggccctggtcaaggccaggggcctatctctcaaaacaactagacggggtttccaaaggctggcccccatgtccaagggccctggcagcaactgccctgttagcacaagaagcagatgagctaactcttaggcaaaacctaaacagaaagtctccccatgctgtggtgactttaataaataccaaaggacatcattagctaataaatgctagactaactagataccaaaccttgctctgtgaaaatccccacaaaaccattgaagtttccaacaccctaacccagccaccttactcctggtaacagagagcccagttaaacataactgtttagaggtgctggactcagtttattctagtaggcctaacctccgagaccacccttaaacatcagtagactgggagctgtacgtggatgggagcggctttgccaacccctgcaaagtgactctgaagaaggagacaagccctgctccagtcacacccagaagctgactggtccacgcacaggcgaagcatgaggaaactcattgcgggactcattttccttaaaatttggacttgtacagtaaggacttcaactgaccttcctcagattgagaactgtttccagtatatacatcaagtcactgagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactga

SEQ ID NO: 10025 - DNA, 853 bp, Artificial Sequence; identical to SEQ ID NO: 9052
  Synthetic polypeptide

SEQ ID NO: 10026 - DNA, 265 bp, Artificial Sequence; identical to SEQ ID NO: 9053
  Synthetic polypeptide

SEQ ID NO: 10027 - DNA, 1327 bp, Artificial Sequence
  Synthetic polypeptide
ggggaacagaccctctgacctactgctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaa

SEQ ID NO: 10028 - DNA, 705 bp, Artificial Sequence
  Synthetic polypeptide
catttatagaagtattgttttctcctcagaggaggagactcgctatatgttgtgcagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaa

SEQ ID NO: 10029 - DNA, 1084 bp, Artificial Sequence
  Synthetic polypeptide
acttctcaaaagaagatatttatgcagccaaaaaacacatgaaaaaatgctcatcatcactggccatcagagaaatgcaaatcaaaaccacagtgagataccatctcacaccagttagaatggcgatcatcaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcctattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacctggatgaagctggaaaccatcattctcagcaaactattgcaaggacaaaaaaccaaacagcacatgttctcactcatagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtag

SEQ ID NO: 10030 - DNA, 1096 bp, Artificial Sequence
  Synthetic polypeptide
acttctcaaaagaagatatttatgcagccaaaaaacacatgaaaaaatgctcatcatcactggccatcagagaaatgcaaatcaaaaccacagtgagataccatctcacaccagttagaatggcgatcatcaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcctattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacctggatgaagctggaaaccatcattctcagcaaactattgcaaggacaaaaaaccaaacagcacatgttctcactcatagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggttggtctctgggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtag

SEQ ID NO: 10031 - DNA, 618 bp, Artificial Sequence
  Synthetic polypeptide
accactacacacctattagatctaggccagaatctggaagactgacaacaccaaatgctgatgaggctgtggggaaagaggaactcttatttattgttcgtgggaattaaaaatggtgtagccattttggaagacaattcgactattccttgcaaaactattcaatctagcagttgcactccttgagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtga

SEQ ID NO: 10032 - DNA, 1211 bp, Artificial Sequence
  Synthetic polypeptide
ggctgggcatggtggctcatgcctgtaatcccagcactttgggatgctcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtag

SEQ ID NO: 10033 - DNA, 1100 bp, Artificial Sequence
  Synthetic polypeptide
ggctgggcatggtggctcatgcctgtaatcccagcactttgggatgctcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaa

SEQ ID NO: 10034 - DNA, 674 bp, Artificial Sequence
  Synthetic polypeptide
ggctgggcatggtggctcatgcctgtaatcccagcactttgggatgctcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaa

SEQ ID NO: 10035 - DNA, 574 bp, Artificial Sequence
  Synthetic polypeptide
tgactctttcacaagttatgttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctga

SEQ ID NO: 10036 - DNA, 462 bp, Artificial Sequence
  Synthetic polypeptide
ccgggcgcggtgactcacgcctgtaatcccagcactttgggaggccgaggtgggcagatcacgagatcaagagatcaagaccatcctggccaacatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtag

SEQ ID NO: 10037 - DNA, 586 bp, Artificial Sequence; identical to SEQ ID NO: 6809
  Synthetic polypeptide

SEQ ID NO: 10038 - DNA, 167 bp, Artificial Sequence
  Synthetic polypeptide
gtggtggctcatgcctgtaatttcagcactttgggaggccaaggcaggcggatcacttgaggtacttgaggttctgtttggattctgcaaagcagactcgtcagaaagttgctgtgaactggaccaacttcagcctcaagaaaaccactcctagcacagctcagtga

SEQ ID NO: 10039 - DNA, 571 bp, Artificial Sequence
  Synthetic polypeptide
gccgggcacggtggctcacgcctgtaatcccagcactttgggaggccaaggcaggtggatcacgaggtcaagagatcaagaccatcctggccaacatggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctag

SEQ ID NO: 10040 - DNA, 494 bp, Artificial Sequence
  Synthetic polypeptide
tgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtgg

SEQ ID NO: 10041 - DNA, 804 bp, Artificial Sequence
  Synthetic polypeptide
tgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaaatataaagtcagacacagagacgttaaataa

SEQ ID NO: 10042 - DNA, 1911 bp, Artificial Sequence
  Synthetic polypeptide
tgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtga

SEQ ID NO: 10043 - DNA, 531 bp, Artificial Sequence
  Synthetic polypeptide
tgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgag

SEQ ID NO: 10044 - DNA, 1055 bp, Artificial Sequence
  Synthetic polypeptide
ggctcacgcctgtaatcccagcactttgggaggtcgaagcaggtggattacttgaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtga

SEQ ID NO: 10045 - DNA, 1037 bp, Artificial Sequence
  Synthetic polypeptide
ggctcacgcctgtaatcccagcactttgggaggtcgaagcaggtggattacttgaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacgaggcctattgtgtag

SEQ ID NO: 10046 - DNA, 653 bp, Artificial Sequence
  Synthetic polypeptide
ggctcacgcctgtaatcccagcactttgggaggtcgaagcaggtggattacttgaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtaa

SEQ ID NO: 10047 - DNA, 3705 bp, Artificial Sequence
  Synthetic polypeptide
aatggaaaatgtaaaggcattagggtcatactgacatgtgtttgaattcaggtcctctgattttacgagctcatgaccttgggggagcgaatcctgccagtctctctggatctctttcttctgtaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataa

SEQ ID NO: 10048 - DNA, 3624 bp, Artificial Sequence
  Synthetic polypeptide
aatggaaaatgtaaaggcattagggtcatactgacatgtgtttgaattcaggtcctctgattttacgagctcatgaccttgggggagcgaatcctgccagtctctctggatctctttcttctgtaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataa

SEQ ID NO: 10049 - DNA, 2865 bp, Artificial Sequence
  Synthetic polypeptide
aatggaaaatgtaaaggcattagggtcatactgacatgtgtttgaattcaggtcctctgattttacgagctcatgaccttgggggagcgaatcctgccagtctctctggatctctttcttctgtaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccaggtaatttggggccaggacagggcaggaacctctccctggagagtggttttcctgcttttctgctgctagaaatgttgctgtatgggagctag

SEQ ID NO: 10050 - DNA, 775 bp, Artificial Sequence
  Synthetic polypeptide
cagtgacaggcccagtgggatgcaggaagcagcctgccctcgctgtgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttga

SEQ ID NO: 10051 - DNA, 417 bp, Artificial Sequence
  Synthetic polypeptide
cagtgacaggcccagtgggatgcaggaagcagcctgccctcgctgtgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctca

SEQ ID NO: 10052 - DNA, 620 bp, Artificial Sequence
  Synthetic polypeptide
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaaaccacagaggaggatctcaacctggatgtggagcccaccacagaagacactgcagaagaagtaactatacacgttttattacactctgctttgtttggggagattgggcccagaaggtggtga

SEQ ID NO: 10053 - DNA, 776 bp, Artificial Sequence
  Synthetic polypeptide
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattga

SEQ ID NO: 10054 - DNA, 371 bp, Artificial Sequence
  Synthetic polypeptide
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaagaaaaattggatggagattacagacagttcactcccttccccctcaactctcccaatcattaacatcttctatagtgtgttacatttgttacaattaatgaactga

SEQ ID NO: 10055 - DNA, 221 bp, Artificial Sequence
  Synthetic polypeptide
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcaagcccgataa

SEQ ID NO: 10056 - DNA, 766 bp, Artificial Sequence
  Synthetic polypeptide
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagac

SEQ ID NO: 10057 - DNA, 1692 bp, Artificial Sequence; identical to SEQ ID NO: 9681
  Synthetic polypeptide

SEQ ID NO: 10058 - DNA, 1319 bp, Artificial Sequence
  Synthetic polypeptide
agtaatcagtatgtctggaactcatattttgttttctaataccatttcctactaaaaggaatcggggatttctggagaaatggctggtctccagggctggggaagaaaagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctgtacatagtactctgaatcaatggagaaatggatattcacctatatgtaagcctcaaataaggtcagaatcttctgcacaactgttacagggaagaaagaaaagacatttgagtgaaacagcattaggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtga

SEQ ID NO: 10059 - DNA, 1193 bp, Artificial Sequence
  Synthetic polypeptide
agtaatcagtatgtctggaactcatattttgttttctaataccatttcctactaaaaggaatcggggatttctggagaaatggctggtctccagggctggggaagaaaagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtga

SEQ ID NO: 10060 - DNA, 473 bp, Artificial Sequence
  Synthetic polypeptide
agtaatcagtatgtctggaactcatattttgttttctaataccatttcctactaaaaggaatcggggatttctggagaaatggctggtctccagggctggggaagaaaagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctggtatgtcacatttacagttcttgtactctatatgcctttttatgtctttatacttactatttttgcattctaagaaaaataaaatctaa

SEQ ID NO: 10061 - DNA, 302 bp, Artificial Sequence
  Synthetic polypeptide
agtaatcagtatgtctggaactcatattttgttttctaataccatttcctactaaaaggaatcggggatttctggagaaatggctggtctccagggctggggaagaaaagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcaggtaagcctccttgtaacaatttctaa

SEQ ID NO: 10062 - DNA, 246 bp, Artificial Sequence
  Synthetic polypeptide
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactatt

SEQ ID NO: 10063 - DNA, 1209 bp, Artificial Sequence
  Synthetic polypeptide
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataa

SEQ ID NO: 10064 - DNA, 1074 bp, Artificial Sequence
  Synthetic polypeptide
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaa

SEQ ID NO: 10065 - DNA, 1317 bp, Artificial Sequence
  Synthetic polypeptide
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataa

SEQ ID NO: 10066 - DNA, 266 bp, Artificial Sequence
  Synthetic polypeptide
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagca

SEQ ID NO: 10067 - DNA, 795 bp, Artificial Sequence
  Synthetic polypeptide
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagagtgcccttttttcaatccttcctgcgattggctgcttttag

SEQ ID NO: 10068 - DNA, 1078 bp, Artificial Sequence
  Synthetic polypeptide
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaa

SEQ ID NO: 10069 - DNA, 229 bp, Artificial Sequence; identical to SEQ ID NO: 7242
  Synthetic polypeptide

SEQ ID NO: 10070 - DNA, 223 bp, Artificial Sequence
  Synthetic polypeptide
caaagtggtgaataataaggctccacacccagatggccgaggttcaaatcccagctctgccgcttgaaggctgtgggatcttagggctcacccttcagaggacaatgacttttacatcaactacaaggacatcgacctggcttcccagcctgtctactgtaacctgcagtcactgggccaggccccaatggatgaagaggagtacgtgatccccgggcactga

SEQ ID NO: 10071 - DNA, 888 bp, Artificial Sequence; identical to SEQ ID NO: 9660
  Synthetic polypeptide

SEQ ID NO: 10072 - DNA, 1254 bp, Artificial Sequence; identical to SEQ ID NO: 9661
  Synthetic polypeptide

SEQ ID NO: 10073 - DNA, 1104 bp, Artificial Sequence; identical to SEQ ID NO: 9662
  Synthetic polypeptide

SEQ ID NO: 10074 - DNA, 1195 bp, Artificial Sequence
  Synthetic polypeptide
tgatatggtttggctgtgttcccacccaaatctcatcttgaatttccacaggttgtgggagggacccagtgggaggtaattgaaccatggaggcaggtctttcctatgctgttctcctgatagtgaataagtctcccaagatctggtgttttttaaaaaaggagagttttcctgcacaagctatctctgcctgctgccattcatgtaagatgtgacttgctcctccttgccttctgccaggattgtgaggcatccccagccatgtggaactcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaa

SEQ ID NO: 10075 - DNA, 553 bp, Artificial Sequence
  Synthetic polypeptide
tgatatggtttggctgtgttcccacccaaatctcatcttgaatttccacaggttgtgggagggacccagtgggaggtaattgaaccatggaggcaggtctttcctatgctgttctcctgatagtgaataagtctcccaagatctggtgttttttaaaaaaggagagttttcctgcacaagctatctctgcctgctgccattcatgtaagatgtgacttgctcctccttgccttctgccaggattgtgaggcatccccagccatgtggaactcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaatactccctggcagccaggcaagagacagaagagccttctctgggattcctgatgcatatagaaaaaagatctga

SEQ ID NO: 10076 - DNA, 1033 bp, Artificial Sequence; identical to SEQ ID NO: 9698
  Synthetic polypeptide

SEQ ID NO: 10077 - DNA, 961 bp, Artificial Sequence; identical to SEQ ID NO: 9699
  Synthetic polypeptide

SEQ ID NO: 10078 - DNA, 709 bp, Artificial Sequence; identical to SEQ ID NO: 9700
  Synthetic polypeptide

SEQ ID NO: 10079 - DNA, 431 bp, Artificial Sequence; identical to SEQ ID NO: 9701
  Synthetic polypeptide

SEQ ID NO: 10080 - DNA, 721 bp, Artificial Sequence
  Synthetic polypeptide
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgaggtctcactccatcggttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaa

SEQ ID NO: 10081 - DNA, 706 bp, Artificial Sequence
  Synthetic polypeptide
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaa

SEQ ID NO: 10082 - DNA, 526 bp, Artificial Sequence
  Synthetic polypeptide
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgagacgaaagtag

SEQ ID NO: 10083 - DNA, 487 bp, Artificial Sequence
  Synthetic polypeptide
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtag

SEQ ID NO: 10084 - DNA, 667 bp, Artificial Sequence
  Synthetic polypeptide
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaa

SEQ ID NO: 10085 - DNA, 592 bp, Artificial Sequence
  Synthetic polypeptide
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaaggtacagatgaagtga

SEQ ID NO: 10086 - DNA, 1420 bp, Artificial Sequence; identical to SEQ ID NO: 9697
  Synthetic polypeptide

SEQ ID NO: 10087 - DNA, 913 bp, Artificial Sequence
  Synthetic polypeptide
ggcacaacaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctga

SEQ ID NO: 10088 - DNA, 321 bp, Artificial Sequence
  Synthetic polypeptide
aagtgggtgaatcacctgaggtcaggcattcgagaccagcctggccaacatagtgaaaaccctcctcttctgaaaatgcaaaaattagcggggcatggtggcacatgcctgtaatctcagctactcgggagactgaagcaggagaatagcttgaacccaggaggcagatgtggcagtgagacgagattgtgccattgcactccagcctgggcgacagagaacatggacgttttgttctcatttcgtgatggagactgcagtaaaggattcttcctggtctctctattggtggaaatagcagctgcttctgcaatcaaagta

SEQ ID NO: 10089 - DNA, 993 bp, Artificial Sequence
  Synthetic polypeptide
aagtgggtgaatcacctgaggtcaggcattcgagaccagcctggccaacatagtgaaaaccctcctcttctgaaaatgcaaaaattagcggggcatggtggcacatgcctgtaatctcagctactcgggagactgaagcaggagaatagcttgaacccaggaggcagatgtggcagtgagacgagattgtgccattgcactccagcctgggcgacagagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaa

SEQ ID NO: 10090 - DNA, 298 bp, Artificial Sequence
  Synthetic polypeptide
aagtgggtgaatcacctgaggtcaggcattcgagaccagcctggccaacatagtgaaaaccctcctcttctgaaaatgcaaaaattagcggggcatggtggcacatgcctgtaatctcagctactcgggagactgaagcaggagaatagcttgaacccaggaggcagatgtggcagtgagacgagattgtgccattgcactccagcctgggcgacagagaacatggacgttttgttctcatttcgtgatggagactgcagtaaaggattcttcctggtctctctattggtggaaatag

SEQ ID NO: 10091 - DNA, 1079 bp, Artificial Sequence; identical to SEQ ID NO: 7188
  Synthetic polypeptide

SEQ ID NO: 10092 - DNA, 1077 bp, Artificial Sequence; identical to SEQ ID NO: 9663
  Synthetic polypeptide

SEQ ID NO: 10093 - DNA, 684 bp, Artificial Sequence; identical to SEQ ID NO: 9664
  Synthetic polypeptide

SEQ ID NO: 10094 - DNA, 1764 bp, Artificial Sequence; identical to SEQ ID NO: 9665
  Synthetic polypeptide

SEQ ID NO: 10095 - DNA, 1716 bp, Artificial Sequence; identical to SEQ ID NO: 9666
  Synthetic polypeptide

SEQ ID NO: 10096 - DNA, 852 bp, Artificial Sequence; identical to SEQ ID NO: 9667
  Synthetic polypeptide

SEQ ID NO: 10097 - DNA, 866 bp, Artificial Sequence; identical to SEQ ID NO: 9659
  Synthetic polypeptide

SEQ ID NO: 10098 - DNA, 3649 bp, Artificial Sequence
  Synthetic polypeptide
tggaaatttaaaatgtgattgggaaaataaacattgaattgaaggattagaaaataatgttgaagaaaaacctaccagaacaacaaaaaagaaatgaaacataggagagaaatatcagaaaactagaggatcaatgcacaaaggccaacagtggattggaatattaagagttccaaaaagagaacagaggaaaagatgaggaagaaattaaggatgaactaacgtaagaaaatttgccaaaacagagaatgagtcttcaatgctaaaaggttgactgagttcccaaaaaagacccgtcctaaggcacatcagtgtgaaattcaggacactgttattaaggagaagatcctaaaagtttccagagcctaaagaaaaaaagaaaaagaaaatgtcatcagagtcctcaatagcaatgctggaacctagaagacaatggaggaataaatgcctttaaaattccaagtgaaaattattttcaacctagaatttggtatcaaaactaccaatcaagtatgaagagagaataaatcagacatgcaagaatttgaaaaattgatctaccatgttccttttcctaggaagatactggagatgtgttccaccaaaataagcgaataaatcaagaaagagggaaacatgcgattcggaaagcaggagaggaaagaaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctga

SEQ ID NO: 10099 - DNA, 3478 bp, Artificial Sequence
  Synthetic polypeptide
tggaaatttaaaatgtgattgggaaaataaacattgaattgaaggattagaaaataatgttgaagaaaaacctaccagaacaacaaaaaagaaatgaaacataggagagaaatatcagaaaactagaggatcaatgcacaaaggccaacagtggattggaatattaagagttccaaaaagagaacagaggaaaagatgaggaagaaattaaggatgaactaacgtaagaaaatttgccaaaacagagaatgagtcttcaatgctaaaaggttgactgagttcccaaaaaagacccgtcctaaggcacatcagtgtgaaattcaggacactgttattaaggagaagatcctaaaagtttccagagcctaaagaaaaaaagaaaaagaaaatgtcatcagagtcctcaatagcaatgctggaacctagaagacaatggaggaataaatgcctttaaaattccaagtgaaaattattttcaacctagaatttggtatcaaaactaccaatcaagtatgaagagagaataaatcagacatgcaagaatttgaaaaattgatctaccatgttccttttcctaggaagatactggagatgtgttccaccaaaataagcgaataaatcaagaaagagggaaacatgcgattcggaaagcaggagaggaaagaaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcaggtaaaagaaaccggacctacctcatgctgcggtcctcccagccctccggcaccccactccaaagtctggactctttccacatcctgctccagacagccaagctttgttggggtccccactgctttgagatgggttcaatctcatccacttggtggccacgggcatctcctgcttcttgggctctgggctcctga

SEQ ID NO: 10100 - DNA, 3472 bp, Artificial Sequence
  Synthetic polypeptide
tggaaatttaaaatgtgattgggaaaataaacattgaattgaaggattagaaaataatgttgaagaaaaacctaccagaacaacaaaaaagaaatgaaacataggagagaaatatcagaaaactagaggatcaatgcacaaaggccaacagtggattggaatattaagagttccaaaaagagaacagaggaaaagatgaggaagaaattaaggatgaactaacgtaagaaaatttgccaaaacagagaatgagtcttcaatgctaaaaggttgactgagttcccaaaaaagacccgtcctaaggcacatcagtgtgaaattcaggacactgttattaaggagaagatcctaaaagtttccagagcctaaagaaaaaaagaaaaagaaaatgtcatcagagtcctcaatagcaatgctggaacctagaagacaatggaggaataaatgcctttaaaattccaagtgaaaattattttcaacctagaatttggtatcaaaactaccaatcaagtatgaagagagaataaatcagacatgcaagaatttgaaaaattgatctaccatgttccttttcctaggaagatactggagatgtgttccaccaaaataagcgaataaatcaagaaagagggaaacatgcgattcggaaagcaggagaggaaagaaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcaggtaaaagaaaccggacctacctcatgctgcggtcctcccagccctccggcaccccactccaaagtctggactctttccacatcctgctccagacagccaagctttgttggggtccccactgctttgagatgggttcaatctcatccacttggtggccacgggcatctcctgcttcttgggctctgggctcctga

SEQ ID NO: 10101 - DNA, 3457 bp, Artificial Sequence
  Synthetic polypeptide
tggaaatttaaaatgtgattgggaaaataaacattgaattgaaggattagaaaataatgttgaagaaaaacctaccagaacaacaaaaaagaaatgaaacataggagagaaatatcagaaaactagaggatcaatgcacaaaggccaacagtggattggaatattaagagttccaaaaagagaacagaggaaaagatgaggaagaaattaaggatgaactaacgtaagaaaatttgccaaaacagagaatgagtcttcaatgctaaaaggttgactgagttcccaaaaaagacccgtcctaaggcacatcagtgtgaaattcaggacactgttattaaggagaagatcctaaaagtttccagagcctaaagaaaaaaagaaaaagaaaatgtcatcagagtcctcaatagcaatgctggaacctagaagacaatggaggaataaatgcctttaaaattccaagtgaaaattattttcaacctagaatttggtatcaaaactaccaatcaagtatgaagagagaataaatcagacatgcaagaatttgaaaaattgatctaccatgttccttttcctaggaagatactggagatgtgttccaccaaaataagcgaataaatcaagaaagagggaaacatgcgattcggaaagcaggagaggaaagaaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccg

SEQ ID NO: 10102 - DNA, 906 bp, Artificial Sequence; identical to SEQ ID NO: 9877
  Synthetic polypeptide

SEQ ID NO: 10103 - DNA, 255 bp, Artificial Sequence; identical to SEQ ID NO: 9878
  Synthetic polypeptide

SEQ ID NO: 10104 - DNA, 255 bp, Artificial Sequence; identical to SEQ ID NO: 9879
  Synthetic polypeptide

SEQ ID NO: 10105 - DNA, 1029 bp, Artificial Sequence; identical to SEQ ID NO: 9690
  Synthetic polypeptide

SEQ ID NO: 10106 - DNA, 957 bp, Artificial Sequence; identical to SEQ ID NO: 9691
  Synthetic polypeptide

SEQ ID NO: 10107 - DNA, 705 bp, Artificial Sequence; identical to SEQ ID NO: 9692
  Synthetic polypeptide

SEQ ID NO: 10108 - DNA, 427 bp, Artificial Sequence; identical to SEQ ID NO: 9693
  Synthetic polypeptide

SEQ ID NO: 10109 - DNA, 996 bp, Artificial Sequence
  Synthetic polypeptide
cataaaaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatgaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtga

SEQ ID NO: 10110 - DNA, 933 bp, Artificial Sequence
  Synthetic polypeptide
cataaaaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatgaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtga

SEQ ID NO: 10111 - DNA, 786 bp, Artificial Sequence
  Synthetic polypeptide
cataaaaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatgaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttag

SEQ ID NO: 10112 - DNA, 342 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgag

SEQ ID NO: 10113 - DNA, 1512 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 10114 - DNA, 1377 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10115 - DNA, 744 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcaactctga

SEQ ID NO: 10116 - DNA, 1564 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagatctcttggaaagtctcacaggcccgcttcattatggcatctgggcccaggacaactggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagcc

SEQ ID NO: 10117 - DNA, 1440 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10118 - DNA, 1446 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 10119 - DNA, 1374 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10120 - DNA, 885 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctcc

SEQ ID NO: 10121 - DNA, 402 bp, Artificial Sequence
  Synthetic polypeptide
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcactacctcctgcaggagatctatggcattgagaacaagaacaaccaggagaccaagccctcggacgacgagaacagcgacaacagcaacgagtgtgtggtgtgcctgtccgac

SEQ ID NO: 10122 - DNA, 1533 bp, Artificial Sequence; identical to SEQ ID NO: 8543
  Synthetic polypeptide

SEQ ID NO: 10123 - DNA, 285 bp, Artificial Sequence; identical to SEQ ID NO: 6932
  Synthetic polypeptide

SEQ ID NO: 10124 - DNA, 333 bp, Artificial Sequence; identical to SEQ ID NO: 6933
  Synthetic polypeptide

SEQ ID NO: 10125 - DNA, 207 bp, Artificial Sequence; identical to SEQ ID NO: 6934
  Synthetic polypeptide

SEQ ID NO: 10126 - DNA, 555 bp, Artificial Sequence; identical to SEQ ID NO: 6935
  Synthetic polypeptide

SEQ ID NO: 10127 - DNA, 225 bp, Artificial Sequence; identical to SEQ ID NO: 6936
  Synthetic polypeptide

SEQ ID NO: 10128 - DNA, 2678 bp, Artificial Sequence
  Synthetic polypeptide
gcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacaagtcaagagcatagtggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaa

SEQ ID NO: 10129 - DNA, 1334 bp, Artificial Sequence
  Synthetic polypeptide
ctttctgagaaacttcatttcccatacataaaatgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaa

SEQ ID NO: 10130 - DNA, 2408 bp, Artificial Sequence
  Synthetic polypeptide
tcatgttacatgacctatcacagacatttgaagtacctactgacttcctcttccctgaaactcttgtccccttggcttccaggacaccgcactctcctggttttcttcttatcccaccacccattccttttcactttcctttgtttgttcctcccccatctattcaacctccaaacactgaagagccccagagttagtctttggttctcttctctatttatttcaatttcccaagttttatggctttaagtatcttctgtaggttattaactcccaatgttatgcctcaactcctacttctcttctaaacttaagaactgtatatccaacatgctcaacatcttctctttggtgcctaagaggcatctctgttttaacaagtccagtaggaagctcttgaccaccctaccttacaaacctgctccttccaagaactttcttcctaggaaagcagaacttcattcttcttgttgtttagaacaagaacctctcaaactccccttctccttgccttccacccacctgtaaaactgaaactcttatttggtgttttttccacgctgggatttatctggggtctgaccacatcttagctactgccatgaccctaatccaagatagcttcacttctcttctgaattattgcaatagcttcctaactgtacttcctccctatcgttttgttctcatttctgcagccaaagagatcctttcaaaatgtaagtcatatcatgtcccccttctgctgaaaaccctccagtggcccccatcccactcaaagtaaaagccaaagtacctgcaatggcccacatgtcttgaacaattcaggcctcatgatctagctttcctgacatctcttcttgtacccctggctcactccattctgtcataatcccctctttttgattctttgaacataccaggcgctctccaaccagctccaggggtgttccctctacttgttatgttctttccccagaggtcagcatgaccacctctctgttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatga

SEQ ID NO: 10131 - DNA, 2174 bp, Artificial Sequence
  Synthetic polypeptide
tcatgttacatgacctatcacagacatttgaagtacctactgacttcctcttccctgaaactcttgtccccttggcttccaggacaccgcactctcctggttttcttcttatcccaccacccattccttttcactttcctttgtttgttcctcccccatctattcaacctccaaacactgaagagccccagagttagtctttggttctcttctctatttatttcaatttcccaagttttatggctttaagtatcttctgtaggttattaactcccaatgttatgcctcaactcctacttctcttctaaacttaagaactgtatatccaacatgctcaacatcttctctttggtgcctaagaggcatctctgttttaacaagtccagtaggaagctcttgaccaccctaccttacaaacctgctccttccaagaactttcttcctaggaaagcagaacttcattcttcttgttgtttagaacaagaacctctcaaactccccttctccttgccttccacccacctgtaaaactgaaactcttatttggtgttttttccacgctgggatttatctggggtctgaccacatcttagctactgccatgaccctaatccaagatagcttcacttctcttctgaattattgcaatagcttcctaactgtacttcctccctatcgttttgttctcatttctgcagccaaagagatcctttcaaaatgtaagtcatatcatgtcccccttctgctgaaaaccctccagtggcccccatcccactcaaagtaaaagccaaagtacctgcaatggcccacatgtcttgaacaattcaggcctcatgatctagctttcctgacatctcttcttgtacccctggctcactccattctgtcataatcccctctttttgattctttgaacataccaggcgctctccaaccagctccaggggtgttccctctacttgttatgttctttccccagaggtcagcatgaccacctctctgttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatga

SEQ ID NO: 10132 - DNA, 1250 bp, Artificial Sequence
  Synthetic polypeptide
tcatgttacatgacctatcacagacatttgaagtacctactgacttcctcttccctgaaactcttgtccccttggcttccaggacaccgcactctcctggttttcttcttatcccaccacccattccttttcactttcctttgtttgttcctcccccatctattcaacctccaaacactgaagagccccagagttagtctttggttctcttctctatttatttcaatttcccaagttttatggctttaagtatcttctgtaggttattaactcccaatgttatgcctcaactcctacttctcttctaaacttaagaactgtatatccaacatgctcaacatcttctctttggtgcctaagaggcatctctgttttaacaagtccagtaggaagctcttgaccaccctaccttacaaacctgctccttccaagaactttcttcctaggaaagcagaacttcattcttcttgttgtttagaacaagaacctctcaaactccccttctccttgccttccacccacctgtaaaactgaaactcttatttggtgttttttccacgctgggatttatctggggtctgaccacatcttagctactgccatgaccctaatccaagatagcttcacttctcttctgaattattgcaatagcttcctaactgtacttcctccctatcgttttgttctcatttctgcagccaaagagatcctttcaaaatgtaagtcatatcatgtcccccttctgctgaaaaccctccagtggcccccatcccactcaaagtaaaagccaaagtacctgcaatggcccacatgtcttgaacaattcaggcctcatgatctagctttcctgacatctcttcttgtacccctggctcactccattctgtcataatcccctctttttgattctttgaacataccaggcgctctccaaccagctccaggggtgttccctctacttgttatgttctttccccagaggtcagcatgaccacctctctgttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggaatgttactgggatgctttactgccatcctcatag

SEQ ID NO: 10133 - DNA, 576 bp, Artificial Sequence; identical to SEQ ID NO: 6344
  Synthetic polypeptide

SEQ ID NO: 10134 - DNA, 852 bp, Artificial Sequence
  Synthetic polypeptide
gggctagaaatgaggagaatgctggttccaattggggcatactcatgagtgaggccagtcacttcacccctctgggtcccagaatcactctgtggaaccaaagagcttcgactagatggtccctaggtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatga

SEQ ID NO: 10135 - DNA, 849 bp, Artificial Sequence
  Synthetic polypeptide
gggctagaaatgaggagaatgctggttccaattggggcatactcatgagtgaggccagtcacttcacccctctgggtcccagaatcactctgtggaaccaaagagcttcgactagatggtccctaggtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatga

SEQ ID NO: 10136 - DNA, 403 bp, Artificial Sequence
  Synthetic polypeptide
gggctagaaatgaggagaatgctggttccaattggggcatactcatgagtgaggccagtcacttcacccctctgggtcccagaatcactctgtggaaccaaagagcttcgactagatggtccctaggtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcg

SEQ ID NO: 10137 - DNA, 321 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgag

SEQ ID NO: 10138 - DNA, 1491 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 10139 - DNA, 1356 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10140 - DNA, 723 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcaactctga

SEQ ID NO: 10141 - DNA, 1543 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagatctcttggaaagtctcacaggcccgcttcattatggcatctgggcccaggacaactggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagcc

SEQ ID NO: 10142 - DNA, 1419 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10143 - DNA, 1425 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 10144 - DNA, 1353 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10145 - DNA, 864 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctcc

SEQ ID NO: 10146 - DNA, 381 bp, Artificial Sequence
  Synthetic polypeptide
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcactacctcctgcaggagatctatggcattgagaacaagaacaaccaggagaccaagccctcggacgacgagaacagcgacaacagcaacgagtgtgtggtgtgcctgtccgac

SEQ ID NO: 10147 - DNA, 3012 bp, Artificial Sequence; identical to SEQ ID NO: 9762
  Synthetic polypeptide

SEQ ID NO: 10148 - DNA, 1116 bp, Artificial Sequence
  Synthetic polypeptide
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaa

SEQ ID NO: 10149 - DNA, 57 bp, Artificial Sequence
  Synthetic polypeptide
gctgagggcacagcaggtgattggagtcagacagctaaggcactgaccccggagcag

SEQ ID NO: 10150 - DNA, 507 bp, Artificial Sequence
  Synthetic polypeptide
gctgagggcacagcaggtgattggagtcagacagctaaggcactgaccccggagcagaagaaggagctgtctgacatcgctcaccgcatcgtggcacctgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgt

SEQ ID NO: 10151 - DNA, 488 bp, Artificial Sequence
  Synthetic polypeptide
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattgggga

SEQ ID NO: 10152 - DNA, 1107 bp, Artificial Sequence
  Synthetic polypeptide
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttag

SEQ ID NO: 10153 - DNA, 1128 bp, Artificial Sequence
  Synthetic polypeptide
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaa

SEQ ID NO: 10154 - DNA, 442 bp, Artificial Sequence
  Synthetic polypeptide
gctgagggcacagcaggtgattggagtcagacagctaaggcactgaccccggagcagaagaaggagctgtctgacatcgctcaccgcatcgtggcacctgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgc

SEQ ID NO: 10155 - DNA, 694 bp, Artificial Sequence
  Synthetic polypeptide
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctgg

SEQ ID NO: 10156 - DNA, 559 bp, Artificial Sequence
  Synthetic polypeptide
agtcagtcgtgtgttgagctgctaaactctaaagtaattttaggtggaagtgttggaaacatgctgctgagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttag

SEQ ID NO: 10157 - DNA, 367 bp, Artificial Sequence; identical to SEQ ID NO: 548
  Synthetic polypeptide

SEQ ID NO: 10158 - DNA, 1710 bp, Artificial Sequence
  Synthetic polypeptide
tgtactggatattttctatttgcctatccatatccagtctctacttttccttgctctgggccaacccatgtgggttggcatcaatggactccattgtcctttatcttccatttggacttgatcaatgggaaacattagcaagagatgggaaggtaagtgggaggagagaaaccgaagtctttaccctgctggtttccttcctgctggactgcagtgggttggctgtgtccctcgactaatgcctcctctcgtgctaggcagcctttggcaaactgctactctctgcaggttttgtaaaccaattctaccccagccccttcatgggcagcaatgacttcctgctgttgcaagccctgaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtag

SEQ ID NO: 10159 - DNA, 789 bp, Artificial Sequence
  Synthetic polypeptide
tgtactggatattttctatttgcctatccatatccagtctctacttttccttgctctgggccaacccatgtgggttggcatcaatggactccattgtcctttatcttccatttggacttgatcaatgggaaacattagcaagagatgggaaggtaagtgggaggagagaaaccgaagtctttaccctgctggtttccttcctgctggactgcagtgggttggctgtgtccctcgactaatgcctcctctcgtgctaggcagcctttggcaaactgctactctctgcaggttttgtaaaccaattctaccccagccccttcatgggcagcaatgacttcctgctgttgcaagccctgaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtag

SEQ ID NO: 10160 - DNA, 587 bp, Artificial Sequence
  Synthetic polypeptide
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatg

SEQ ID NO: 10161 - DNA, 1246 bp, Artificial Sequence
  Synthetic polypeptide
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcggagtgcctgcagggcaccatccgcaacagccaggaggcggaggtctcctgccccttcattgacaacacctactcgtgctcgggcaagctgctggagagggagatcaaggcgctcctga

SEQ ID NO: 10162 - DNA, 1768 bp, Artificial Sequence
  Synthetic polypeptide
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactga

SEQ ID NO: 10163 - DNA, 1054 bp, Artificial Sequence
  Synthetic polypeptide
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagggagtgcctgcagggcaccatccgcaacagccaggaggcggaggtctcctgccccttcattga

SEQ ID NO: 10164 - DNA, 553 bp, Artificial Sequence
  Synthetic polypeptide
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcagattcctcatggtgcaaaatggccattccagctccatccagccatcacatcacaggaggaagggaagaaagacacccctccacactcttctaaagagcatagctcaaaaattgtacacacttcttccgttaattcctgtggaccagaactga

SEQ ID NO: 10165 - DNA, 2471 bp, Artificial Sequence; identical to SEQ ID NO: 576
  Synthetic polypeptide

SEQ ID NO: 10166 - DNA, 1128 bp, Artificial Sequence
  Synthetic polypeptide
ggccgggcatggtggctcacgcctataatcccagcactttgggagaccaaggcaggcggatcacctgaggtcgggagtttgagaccagcctgaccaacatggagaaaccccatctctactaaaaatacaaaattaaccaggcgtgacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 10167 - DNA, 1095 bp, Artificial Sequence
  Synthetic polypeptide
ggccgggcatggtggctcacgcctataatcccagcactttgggagaccaaggcaggcggatcacctgaggtcgggagtttgagaccagcctgaccaacatggagaaaccccatctctactaaaaatacaaaattaaccaggcgtgacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 10168 - DNA, 915 bp, Artificial Sequence
  Synthetic polypeptide
ggccgggcatggtggctcacgcctataatcccagcactttgggagaccaaggcaggcggatcacctgaggtcgggagtttgagaccagcctgaccaacatggagaaaccccatctctactaaaaatacaaaattaaccaggcgtgacggttccaagtggacttattttgtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 10169 - DNA, 2003 bp, Artificial Sequence; identical to SEQ ID NO: 8385
  Synthetic polypeptide

SEQ ID NO: 10170 - DNA, 949 bp, Artificial Sequence
  Synthetic polypeptide
acaataagaatcaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtag

SEQ ID NO: 10171 - DNA, 328 bp, Artificial Sequence
  Synthetic polypeptide
acaataagaatcaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccag

SEQ ID NO: 10172 - DNA, 1425 bp, Artificial Sequence
  Synthetic polypeptide
ctattgacagcacatttgttaaattcccccaaattcagatattgaaatcctaatccccaagtggtggtatctggaggtgaagggtttcacccttggaaagtaattaaccatgaggttggagctcttgtgatgggattagtactcttataagaagagacacaagagagtttgcttcttctctgtccccaccaggtgaagatacagcaagaaggcatctactcgcaaaccaagaagaaggccctcaccaggaaccgagttacttgcatcttcatcttgaacttcctggtctccagaagaattccatgtggatggctcatgaacaaaaatgagaaacacgacgataaactggtaatgttcaccaatcaatctgaagattctgaaagatgtgaaagcatggagctggacaaaaaaatccaggatctgattgagagaaatgcgtctcctcatccaaaacggttcaccccagaggccatgccaactcacagaaatctatgttctctgaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccagtttatcctcagtaa

SEQ ID NO: 10173 - DNA, 694 bp, Artificial Sequence
  Synthetic polypeptide
tgatgtggtttggctgtgtctccacccaaatctcatcttgaattcccacatttgtgggagggacccactgggaggtaagtgaatcatgagagcaggtccttcccatgctgttctcctgatactgagtaagtctcatgagatctgatggttattataaggggggattttcctgcacaagctctctctttgcctgctgccatccatgtaagatgtgacttgctcctccttgctttctgccaagattgtgagacttccccagccacgtggaactgtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtga

SEQ ID NO: 10174 - DNA, 760 bp, Artificial Sequence
  Synthetic polypeptide
tgatgtggtttggctgtgtctccacccaaatctcatcttgaattcccacatttgtgggagggacccactgggaggtaagtgaatcatgagagcaggtccttcccatgctgttctcctgatactgagtaagtctcatgagatctgatggttattataaggggggattttcctgcacaagctctctctttgcctgctgccatccatgtaagatgtgacttgctcctccttgctttctgccaagattgtgagacttccccagccacgtggaactgtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaatcagagaactccagaatccttggaaagcctgcccactagtttttcaagtccccactacatcacactgaaacctgcaagtaaagattcaagaggaatcgcagatcccaatcaaagtgccaagtga

SEQ ID NO: 10175 - DNA, 664 bp, Artificial Sequence
  Synthetic polypeptide
tgatgtggtttggctgtgtctccacccaaatctcatcttgaattcccacatttgtgggagggacccactgggaggtaagtgaatcatgagagcaggtccttcccatgctgttctcctgatactgagtaagtctcatgagatctgatggttattataaggggggattttcctgcacaagctctctctttgcctgctgccatccatgtaagatgtgacttgctcctccttgctttctgccaagattgtgagacttccccagccacgtggaactgtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaatcacctcttatatggaaggcatcaatga

SEQ ID NO: 10176 - DNA, 420 bp, Artificial Sequence
  Synthetic polypeptide
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaaga

SEQ ID NO: 10177 - DNA, 529 bp, Artificial Sequence
  Synthetic polypeptide
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaa

SEQ ID NO: 10178 - DNA, 772 bp, Artificial Sequence
  Synthetic polypeptide
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataa

SEQ ID NO: 10179 - DNA, 250 bp, Artificial Sequence
  Synthetic polypeptide
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagagtgcccttttttcaatccttcctgcgattggctgcttttag

SEQ ID NO: 10180 - DNA, 533 bp, Artificial Sequence
  Synthetic polypeptide
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaa

SEQ ID NO: 10181 - DNA, 706 bp, Artificial Sequence
  Synthetic polypeptide
caccctcctacctcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactga

SEQ ID NO: 10182 - DNA, 386 bp, Artificial Sequence
  Synthetic polypeptide
caccctcctacctcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggcc

SEQ ID NO: 10183 - DNA, 75 bp, Artificial Sequence
  Synthetic polypeptide
caccctcctacctcaggtggtccgcaacatgacctccgagttcttcgctgcccagctccgggcccagatctctga

SEQ ID NO: 10184 - DNA, 565 bp, Artificial Sequence
  Synthetic polypeptide
ttaaaaatattctttccctttgatccagctagaaaaattgtgatatagggatattctcacaagtgttcaagaaatgcaaaattccaacatttgcaaaagcaagaaaactggacagcctaaatgcccagcagtacagtcataagctggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccagacgaggtcttgctatgttgaccaggctggtcttgaactcctggccttaa

SEQ ID NO: 10185 - DNA, 844 bp, Artificial Sequence
  Synthetic polypeptide
ttaaaaatattctttccctttgatccagctagaaaaattgtgatatagggatattctcacaagtgttcaagaaatgcaaaattccaacatttgcaaaagcaagaaaactggacagcctaaatgcccagcagtacagtcataagctggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagaggatattcaaaagtacacctgccgagtcccagccctga

SEQ ID NO: 10186 - DNA, 883 bp, Artificial Sequence
  Synthetic polypeptide
ttaaaaatattctttccctttgatccagctagaaaaattgtgatatagggatattctcacaagtgttcaagaaatgcaaaattccaacatttgcaaaagcaagaaaactggacagcctaaatgcccagcagtacagtcataagctggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtga

SEQ ID NO: 10187 - DNA, 1429 bp, Artificial Sequence
  Synthetic polypeptide
atgtggtttggctctgtgtcaccaccttgaattgtaatccccacgtgttgagggagaaacccagtgggaggtgattggatcacgggggtggtttccctcatgctgttctcatgatagtgagtgagctctcatgatatctgatggtttaaaagtggcacttctgcctttgctcgttttctcctgccgccataaaagacttgctttgcttccccttctgccatgatttaagtttcctgaagtccctgcagccaagtagaactgccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaa

SEQ ID NO: 10188 - DNA, 595 bp, Artificial Sequence
  Synthetic polypeptide
ggccaggcgcggtggctcacgcctgtaatcccagcacttagggaggctgaggcaggcggatcacgaggtcaggagatcaagaccatcctggctaacacggtgaaaccccagcgctaataaaaatacaaaaaaaattagccggatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctga

SEQ ID NO: 10189 - DNA, 353 bp, Artificial Sequence
  Synthetic polypeptide
ggacagatgcggtggctcgtgcctgtaattgcagcactttgagaggccgaggaatccagccggctgtctttgctttcccatgtgctacacttatcactgtgatgttggccttcatcatgtacatgaccctgcggaatgccactcagcaaaaggacatggtggaggtggctgattttgacttttcccccatgtctgacaagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtga

SEQ ID NO: 10190 - DNA, 317 bp, Artificial Sequence
  Synthetic polypeptide
ggacagatgcggtggctcgtgcctgtaattgcagcactttgagaggccgaggaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtga

SEQ ID NO: 10191 - DNA, 934 bp, Artificial Sequence
  Synthetic polypeptide
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtga

SEQ ID NO: 10192 - DNA, 1003 bp, Artificial Sequence
  Synthetic polypeptide
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtga

SEQ ID NO: 10193 - DNA, 580 bp, Artificial Sequence
  Synthetic polypeptide
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagg

SEQ ID NO: 10194 - DNA, 182 bp, Artificial Sequence
  Synthetic polypeptide
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtga

SEQ ID NO: 10195 - DNA, 575 bp, Artificial Sequence
  Synthetic polypeptide
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcc

SEQ ID NO: 10196 - DNA, 166 bp, Artificial Sequence
  Synthetic polypeptide
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctg

SEQ ID NO: 10197 - DNA, 161 bp, Artificial Sequence
  Synthetic polypeptide
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctct

SEQ ID NO: 10198 - DNA, 88 bp, Artificial Sequence
  Synthetic polypeptide
cctctctccttcattttcctcactgaaacaaaatgtacggaccaggtgactctgaggcttctttcagttataagatactatgtattag

SEQ ID NO: 10199 - DNA, 1946 bp, Artificial Sequence
  Synthetic polypeptide
gccaggcaccgcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtga

SEQ ID NO: 10200 - DNA, 2084 bp, Artificial Sequence
  Synthetic polypeptide
gccaggcaccgcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtga

SEQ ID NO: 10201 - DNA, 543 bp, Artificial Sequence
  Synthetic polypeptide
tgatgtggtttggctgtgtccctacccaaatctgatcttgcattcccacatgttgtgggaggggcctggtgggaggtaattgaatcatggggacaggtctttcccatgctgttctcgtgatagtgggtaagtctcatgacatctgatggtgatataagaaggagtttccctgcacaagctctctttttgcctgctgccatccatgttagacgtgactttgctcctcctttgccttcttccatgattgtgaggcctccccagccatgtggaactacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtga

SEQ ID NO: 10202 - DNA, 717 bp, Artificial Sequence
  Synthetic polypeptide
tctgccactgtctagctgttgattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctga

SEQ ID NO: 10203 - DNA, 101 bp, Artificial Sequence
  Synthetic polypeptide
tctgccactgtctagctgttgattttcatgttccagctgctccggggcctcgcctactgtcaccaccgcaagatcctgcaccgggacctgaagccccagaa

SEQ ID NO: 10204 - DNA, 53 bp, Artificial Sequence
  Synthetic polypeptide
tctgccactgtctagctgttgattttcatgttccagctgctccggggcctcgc

SEQ ID NO: 10205 - DNA, 761 bp, Artificial Sequence
  Synthetic polypeptide
tatggtttgaatgtttgtcccctctaaaactcatattaaaaattaatccccaatgtggcagtattgagaggtggtgcctttaagaggtgattgagtcaagagggctctgcactaatgaatagattaatccatttatggattactggattaatagtttaacgggttaatgaattaccacgggactgggacttctagctttgtaagaagaggaagagagacccgagctagcacactcagtccccttgctatgtgatgttctttaccatctcaggactctgcacagagtccccaacagcaagaaggccctcaccagatacagccccttgacctgggacttctcagcctccataaccatttttggccatataaaccaccatctttcggggttgaaagattctcattgtctagtttttctgcaagccccacctgtgccctggatcattttagccagctttctctggattctcggaaatccctggacgtcttccacggctactgcaggatttagccaaatttgggtgctatttcccttttgtggagggacttttcatcacaatgagaaggacgtcttaggactccaggactttgagagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaa

SEQ ID NO: 10206 - DNA, 2105 bp, Artificial Sequence; identical to SEQ ID NO: 9726
  Synthetic polypeptide

SEQ ID NO: 10207 - DNA, 1592 bp, Artificial Sequence; identical to SEQ ID NO: 9727
  Synthetic polypeptide

SEQ ID NO: 10208 - DNA, 2147 bp, Artificial Sequence; identical to SEQ ID NO: 9728
  Synthetic polypeptide

SEQ ID NO: 10209 - DNA, 1960 bp, Artificial Sequence
  Synthetic polypeptide
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacagttatatgaaagagtgatttaccttattctgtaacagcacagggctgaattatggccaatatgtttaaaatagtatagagagaagatttcagctcaatagggagaaatgtgctaatatgtagagctgtccaaaaatcaaattgactcttttggaaagcagtgggttgattctctcatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10210 - DNA, 1684 bp, Artificial Sequence
  Synthetic polypeptide
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacagttatatgaaagagtgatttaccttattctgtaacagcacagggctgaattatggccaatatgtttaaaatagtatagagagaagatttcagctcaatagggagaaatgtgctaatatgtagagctgtccaaaaatcaaattgactcttttggaaagcagtgggttgattctctcatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10211 - DNA, 1363 bp, Artificial Sequence
  Synthetic polypeptide
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacagttatatgaaagagtgatttaccttattctgtaacagcacagggctgaattatggccaatatgtttaaaatagtatagagagaagatttcagctcaatagggagaaatgtgctaatatgtagagctgtccaaaaatcaaattgactcttttggaaagcagtgggttgattctctcatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10212 - DNA, 693 bp, Artificial Sequence
  Synthetic polypeptide
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctga

SEQ ID NO: 10213 - DNA, 410 bp, Artificial Sequence
  Synthetic polypeptide
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatcca

SEQ ID NO: 10214 - DNA, 557 bp, Artificial Sequence
  Synthetic polypeptide
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccact

SEQ ID NO: 10215 - DNA, 373 bp, Artificial Sequence
  Synthetic polypeptide
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctag

SEQ ID NO: 10216 - DNA, 417 bp, Artificial Sequence
  Synthetic polypeptide
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaac

SEQ ID NO: 10217 - DNA, 232 bp, Artificial Sequence
  Synthetic polypeptide
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtgg

SEQ ID NO: 10218 - DNA, 411 bp, Artificial Sequence
  Synthetic polypeptide
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccat

SEQ ID NO: 10219 - DNA, 265 bp, Artificial Sequence
  Synthetic polypeptide
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgag

SEQ ID NO: 10220 - DNA, 380 bp, Artificial Sequence; identical to SEQ ID NO: 682
  Synthetic polypeptide

SEQ ID NO: 10221 - DNA, 422 bp, Artificial Sequence; identical to SEQ ID NO: 683
  Synthetic polypeptide

SEQ ID NO: 10222 - DNA, 271 bp, Artificial Sequence; identical to SEQ ID NO: 684
  Synthetic polypeptide

SEQ ID NO: 10223 - DNA, 197 bp, Artificial Sequence; identical to SEQ ID NO: 685
  Synthetic polypeptide

SEQ ID NO: 10224 - DNA, 524 bp, Artificial Sequence; identical to SEQ ID NO: 686
  Synthetic polypeptide

SEQ ID NO: 10225 - DNA, 229 bp, Artificial Sequence
  Synthetic polypeptide
ccccgtcagaatagaatctccttgtatgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattag

SEQ ID NO: 10226 - DNA, 784 bp, Artificial Sequence
  Synthetic polypeptide
ccgggcgtggtggctcacacctgtaatcccagcactctgggaggccaaggcaggcggatcacgacgtcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctga

SEQ ID NO: 10227 - DNA, 103 bp, Artificial Sequence
  Synthetic polypeptide
ccgggcgtggtggctcacacctgtaatcccagcactctgggaggccaaggcaggcggatcacgacgtcagaatgcagagagcagtttgcagcagaagaatgaa

SEQ ID NO: 10228 - DNA, 609 bp, Artificial Sequence
  Synthetic polypeptide
ccgggcgtggtggctcacacctgtaatcccagcactctgggaggccaaggcaggcggatcacgacgtcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtg

SEQ ID NO: 10229 - DNA, 1269 bp, Artificial Sequence; identical to SEQ ID NO: 616
  Synthetic polypeptide

SEQ ID NO: 10230 - DNA, 1134 bp, Artificial Sequence; identical to SEQ ID NO: 617
  Synthetic polypeptide

SEQ ID NO: 10231 - DNA, 501 bp, Artificial Sequence; identical to SEQ ID NO: 618
  Synthetic polypeptide

SEQ ID NO: 10232 - DNA, 1321 bp, Artificial Sequence; identical to SEQ ID NO: 619
  Synthetic polypeptide

SEQ ID NO: 10233 - DNA, 1197 bp, Artificial Sequence; identical to SEQ ID NO: 620
  Synthetic polypeptide

SEQ ID NO: 10234 - DNA, 1203 bp, Artificial Sequence; identical to SEQ ID NO: 621
  Synthetic polypeptide

SEQ ID NO: 10235 - DNA, 1131 bp, Artificial Sequence; identical to SEQ ID NO: 622
  Synthetic polypeptide

SEQ ID NO: 10236 - DNA, 642 bp, Artificial Sequence; identical to SEQ ID NO: 623
  Synthetic polypeptide

SEQ ID NO: 10237 - DNA, 526 bp, Artificial Sequence
  Synthetic polypeptide
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 10238 - DNA, 1314 bp, Artificial Sequence
  Synthetic polypeptide
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaa

SEQ ID NO: 10239 - DNA, 1218 bp, Artificial Sequence
  Synthetic polypeptide
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctag

SEQ ID NO: 10240 - DNA, 1197 bp, Artificial Sequence
  Synthetic polypeptide
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctga

SEQ ID NO: 10241 - DNA, 919 bp, Artificial Sequence
  Synthetic polypeptide
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcagttaagcctgagcccttgccacacggatttccttctcacccgcttcctccccgcaccactctggggatcagaagtatcagtgccaagtggtccctttcatctcctcataattcttccccagccacttagtgggttagtcaggccctgccttctcttcagccagccctgcagtc

SEQ ID NO: 10242 - DNA, 629 bp, Artificial Sequence
  Synthetic polypeptide
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtcca

SEQ ID NO: 10243 - DNA, 1784 bp, Artificial Sequence
  Synthetic polypeptide
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10244 - DNA, 1508 bp, Artificial Sequence
  Synthetic polypeptide
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10245 - DNA, 1187 bp, Artificial Sequence
  Synthetic polypeptide
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10246 - DNA, 853 bp, Artificial Sequence
  Synthetic polypeptide
tatgttcactccacttggatttgagctggccttgggatttgcatcagctactagaatgtggcagcagcaatgttgtgccaactccaggcttagccacttagagccctgacagcttctgctgtggctcaccttggagccctgagccaccaaataaggaattcaacaaccctgctgaggagaggcccagacagctcccagatcttcagccaccacagctgaggacccagatatggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggatggataa

SEQ ID NO: 10247 - DNA, 1085 bp, Artificial Sequence
  Synthetic polypeptide
acagcatgaaggttaagagcggaggacacagagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactga

SEQ ID NO: 10248 - DNA, 577 bp, Artificial Sequence
  Synthetic polypeptide
cagtgcaaagggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccgcggcagttcaatgacctctgggtccgcatcgaggacagcaccaccgcctcaccacccccgctgcccctgcagcccacccacagctcggggaccgccaagccccccttccagctttcagaccagctacaacagcaggacccgccagggcccgccagcagctcggcacccaccctgggccttctccccgccatcgccaccaccatcgctgtctgcttcctgctgcatagccttgggccctcctga

SEQ ID NO: 10249 - DNA, 519 bp, Artificial Sequence; identical to SEQ ID NO: 9679
  Synthetic polypeptide

SEQ ID NO: 10250 - DNA, 213 bp, Artificial Sequence; identical to SEQ ID NO: 9680
  Synthetic polypeptide

SEQ ID NO: 10251 - DNA, 773 bp, Artificial Sequence
  Synthetic polypeptide
tttcttggttccctgaccaggaaacgaggtaactgatggacagccgaggcagccccttaggcggcttaggcctcccctgtggagcatccctgaggcggactccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtga

SEQ ID NO: 10252 - DNA, 1110 bp, Artificial Sequence; identical to SEQ ID NO: 8310
  Synthetic polypeptide

SEQ ID NO: 10253 - DNA, 175 bp, Artificial Sequence
  Synthetic polypeptide
tgaaaggaccccaggcatcagtattcagagactgcgattgttacattagcgtgactttttgcaacttatgtgactttggctccagaaacatgacaaggaggactttcctgcctcttggagatcagaggaggaaatggcagcagaagccgcagctctgcgggtctactttcagtga

SEQ ID NO: 10254 - DNA, 1911 bp, Artificial Sequence
  Synthetic polypeptide
tgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtga

SEQ ID NO: 10255 - DNA, 804 bp, Artificial Sequence
  Synthetic polypeptide
tgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaaatataaagtgagacacagagaagttaaataa

SEQ ID NO: 10256 - DNA, 531 bp, Artificial Sequence
  Synthetic polypeptide
tgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgag

SEQ ID NO: 10257 - DNA, 494 bp, Artificial Sequence
  Synthetic polypeptide
tgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtgg

SEQ ID NO: 10258 - DNA, 1335 bp, Artificial Sequence
  Synthetic polypeptide
aggggaaaataataacttacgtgtgtggaaacacctggcagacactcttcccaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatga

SEQ ID NO: 10259 - DNA, 1197 bp, Artificial Sequence
  Synthetic polypeptide
aggggaaaataataacttacgtgtgtggaaacacctggcagacactcttcccaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatga

SEQ ID NO: 10260 - DNA, 2084 bp, Artificial Sequence
  Synthetic polypeptide
gccaggcacggcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtga

SEQ ID NO: 10261 - DNA, 1946 bp, Artificial Sequence
  Synthetic polypeptide
gccaggcacggcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtga

SEQ ID NO: 10262 - DNA, 647 bp, Artificial Sequence
  Synthetic polypeptide
gccaggcacggcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggac

SEQ ID NO: 10263 - DNA, 182 bp, Artificial Sequence
  Synthetic polypeptide
gccaggcacggcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcg

SEQ ID NO: 10264 - DNA, 1486 bp, Artificial Sequence
  Synthetic polypeptide
acagtaggacagggcaccagtcagagtcatgagaccgcctttccaggacttagctaccagatgacttttctagacacagcctgcatcagaagggaacttgctgccttgaaaggaaagatccagtccaggagtcatcacttgctaactgaagagtccttgggcccttataaccagcagcaatacacagtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaa

SEQ ID NO: 10265 - DNA, 662 bp, Artificial Sequence
  Synthetic polypeptide
tgtaatgggttgaattgtgtcctgcgtctccaccaaaaaaaaaaaaaaaatggttgaagccctaacccccagtacctcagaatgtgaccttatttggaaatagggtcattgcagatgtaacgttaagatgaggtcatactcaatgagtatgagctctaatccaccctaagaaaagagacacacacatgaggagaaaatgtcacgtgaagatagaggcagggactgcagggctgcagctgcaaaccaagacacaccaggggcttccggcaaccacaggaagctgggaataggcaaggaaagattccccctacaggtttccggggaagcacagccacgctgacacattgatttggacttctagctatcagagcagtgggacaataaatttctgttgtttaaactactcgtttgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctga

SEQ ID NO: 10266 - DNA, 2585 bp, Artificial Sequence
  Synthetic polypeptide
aataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatag

SEQ ID NO: 10267 - DNA, 172 bp, Artificial Sequence
  Synthetic polypeptide
aataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaa

SEQ ID NO: 10268 - DNA, 180 bp, Artificial Sequence
  Synthetic polypeptide
aataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaaagaagtag

SEQ ID NO: 10269 - DNA, 229 bp, Artificial Sequence
  Synthetic polypeptide
aataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaaagaagtagcagtgtccaaggaacaagaagagaaatctgatagcctagttaaatattt

SEQ ID NO: 10270 - DNA, 14244 bp, Artificial Sequence
  Synthetic polypeptide
gcttcccatctcatgaagagtcaaagtccaagtccttactatgatctacaagaccctaaccatttggccttcacatcacctccctgacctcatttccttctcctctccccatgcacagtgcaccaggcacagtgatatccttgttttccctgacatggtgagcacttttgggcctttgcacttgcccccctttttcctaaatgctcttgcctcagatggtgcatgacttacttcctttcctcctacaggtctttgctcataggtcaccctctcagtgtggccttctctgattctttcccgacctcttctttcctgatttactttctccattgcgcttaccaccatctgacataagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgtgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacgtgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcagctgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatag

SEQ ID NO: 10271 - DNA, 3954 bp, Artificial Sequence
  Synthetic polypeptide
gcttcccatctcatgaagagtcaaagtccaagtccttactatgatctacaagaccctaaccatttggccttcacatcacctccctgacctcatttccttctcctctccccatgcacagtgcaccaggcacagtgatatccttgttttccctgacatggtgagcacttttgggcctttgcacttgcccccctttttcctaaatgctcttgcctcagatggtgcatgacttacttcctttcctcctacaggtctttgctcataggtcaccctctcagtgtggccttctctgattctttcccgacctcttctttcctgatttactttctccattgcgcttaccaccatctgacataagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttgggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctga

SEQ ID NO: 10272 - DNA, 296 bp, Artificial Sequence
  Synthetic polypeptide
gctgggtgtgatggttcatgcctatagtcacagcactttaggaagcggtggcgggcggatcacttgagctcaggagtttaagtccagcctggccaacatggagaaaccctgtctctactaaaaatacaaaaattaacccgaccatagtaacctgggaggaggagcacctggtgtgtgtgcagaaaggggaggtccccaaccggggctggagacactggctggagggagagatgctgtatctggaactgactgcaagggatgcagtgtgcgagcaggtcttcaggaaggtcagatag

SEQ ID NO: 10273 - DNA, 1951 bp, Artificial Sequence
  Synthetic polypeptide
ggccaggtgcagtgactcacacttgtaatcccagcactttgggaggccgaggcacgtggatcacttgagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagagaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataa

SEQ ID NO: 10274 - DNA, 2263 bp, Artificial Sequence
  Synthetic polypeptide
ggccaggtgcagtgactcacacttgtaatcccagcactttgggaggccgaggcacgtggatcacttgagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataa

SEQ ID NO: 10275 - DNA, 1222 bp, Artificial Sequence
  Synthetic polypeptide
ggccaggtgcagtgactcacacttgtaatcccagcactttgggaggccgaggcacgtggatcacttgagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaagacacagggaatatggaggttctgcacctgtatggaagtgaggaacagaagaaacagtggcttgagcctcttcttcaagggaacattacctcttgcttctgtatga

SEQ ID NO: 10276 - DNA, 1351 bp, Artificial Sequence
  Synthetic polypeptide
ggccaggtgcagtgactcacacttgtaatcccagcactttgggaggccgaggcacgtggatcacttgagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccaggttactacattaattga

SEQ ID NO: 10277 - DNA, 541 bp, Artificial Sequence
  Synthetic polypeptide
tgatgtggtttggctgtgtccacacccaaatctcatcttgaattcccacatgttgtgggagggacccagttggaggtaattgaatcatgggggtaggtctttcctgtgctgttcttgtgatagtgaataagtctcacaagatctgatggtggtataagaaggagtttccctgcacaagctctctttttgcctgctgccatccatctaagatgtgacttgctcctccttgccttctgccatgattgtgaggcctccccagccatgtggaactacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtga

SEQ ID NO: 10278 - DNA, 1133 bp, Artificial Sequence; identical to SEQ ID NO: 7332
  Synthetic polypeptide

SEQ ID NO: 10279 - DNA, 1172 bp, Artificial Sequence; identical to SEQ ID NO: 7333
  Synthetic polypeptide

SEQ ID NO: 10280 - DNA, 1295 bp, Artificial Sequence; identical to SEQ ID NO: 9886
  Synthetic polypeptide

SEQ ID NO: 10281 - DNA, 632 bp, Artificial Sequence; identical to SEQ ID NO: 9887
  Synthetic polypeptide

SEQ ID NO: 10282 - DNA, 935 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 10283 - DNA, 383 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 10284 - DNA, 199 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 10285 - DNA, 476 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 10286 - DNA, 971 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 10287 - DNA, 890 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 10288 - DNA, 653 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 10289 - DNA, 569 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 10290 - DNA, 632 bp, Artificial Sequence
  Synthetic polypeptide
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 10291 - DNA, 943 bp, Artificial Sequence; identical to SEQ ID NO: 9889
  Synthetic polypeptide

SEQ ID NO: 10292 - DNA, 80 bp, Artificial Sequence; identical to SEQ ID NO: 6364
  Synthetic polypeptide

SEQ ID NO: 10293 - DNA, 217 bp, Artificial Sequence; identical to SEQ ID NO: 6365
  Synthetic polypeptide

SEQ ID NO: 10294 - DNA, 2484 bp, Artificial Sequence; identical to SEQ ID NO: 9884
  Synthetic polypeptide

SEQ ID NO: 10295 - DNA, 560 bp, Artificial Sequence; identical to SEQ ID NO: 6322
  Synthetic polypeptide

SEQ ID NO: 10296 - DNA, 180 bp, Artificial Sequence
  Synthetic polypeptide
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgt

SEQ ID NO: 10297 - DNA, 311 bp, Artificial Sequence
  Synthetic polypeptide
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctga

SEQ ID NO: 10298 - DNA, 380 bp, Artificial Sequence
  Synthetic polypeptide
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttga

SEQ ID NO: 10299 - DNA, 335 bp, Artificial Sequence
  Synthetic polypeptide
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccagctctgtgaaggtcagactgtgaggagaagccaccccttgagcgctccgtctcctgatagtgccagcctggcctggtttcctgtttga

SEQ ID NO: 10300 - DNA, 260 bp, Artificial Sequence
  Synthetic polypeptide
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccaggaaaccctgtag

SEQ ID NO: 10301 - DNA, 395 bp, Artificial Sequence
  Synthetic polypeptide
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctga

SEQ ID NO: 10302 - DNA, 2781 bp, Artificial Sequence; identical to SEQ ID NO: 7524
  Synthetic polypeptide

SEQ ID NO: 10303 - DNA, 459 bp, Artificial Sequence; identical to SEQ ID NO: 6510
  Synthetic polypeptide

SEQ ID NO: 10304 - DNA, 504 bp, Artificial Sequence; identical to SEQ ID NO: 6511
  Synthetic polypeptide

SEQ ID NO: 10305 - DNA, 336 bp, Artificial Sequence; identical to SEQ ID NO: 7520
  Synthetic polypeptide

SEQ ID NO: 10306 - DNA, 346 bp, Artificial Sequence; identical to SEQ ID NO: 7521
  Synthetic polypeptide

SEQ ID NO: 10307 - DNA, 282 bp, Artificial Sequence; identical to SEQ ID NO: 7621
  Synthetic polypeptide

SEQ ID NO: 10308 - DNA, 285 bp, Artificial Sequence; identical to SEQ ID NO: 6477
  Synthetic polypeptide

SEQ ID NO: 10309 - DNA, 238 bp, Artificial Sequence; identical to SEQ ID NO: 6378
  Synthetic polypeptide

SEQ ID NO: 10310 - DNA, 1965 bp, Artificial Sequence; identical to SEQ ID NO: 8289
  Synthetic polypeptide

SEQ ID NO: 10311 - DNA, 1207 bp, Artificial Sequence
  Synthetic polypeptide
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatga

SEQ ID NO: 10312 - DNA, 994 bp, Artificial Sequence
  Synthetic polypeptide
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgatgccgctatcaccatggggatggttcttctaa

SEQ ID NO: 10313 - DNA, 1108 bp, Artificial Sequence
  Synthetic polypeptide
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggactttttaa

SEQ ID NO: 10314 - DNA, 1033 bp, Artificial Sequence
  Synthetic polypeptide
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgacatcttag

SEQ ID NO: 10315 - DNA, 1210 bp, Artificial Sequence
  Synthetic polypeptide
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtga

SEQ ID NO: 10316 - DNA, 630 bp, Artificial Sequence; identical to SEQ ID NO: 9907
  Synthetic polypeptide

SEQ ID NO: 10317 - DNA, 711 bp, Artificial Sequence; identical to SEQ ID NO: 9908
  Synthetic polypeptide

SEQ ID NO: 10318 - DNA, 277 bp, Artificial Sequence; identical to SEQ ID NO: 9898
  Synthetic polypeptide

SEQ ID NO: 10319 - DNA, 406 bp, Artificial Sequence; identical to SEQ ID NO: 9899
  Synthetic polypeptide

SEQ ID NO: 10320 - DNA, 475 bp, Artificial Sequence; identical to SEQ ID NO: 9900
  Synthetic polypeptide

SEQ ID NO: 10321 - DNA, 430 bp, Artificial Sequence; identical to SEQ ID NO: 9901
  Synthetic polypeptide

SEQ ID NO: 10322 - DNA, 490 bp, Artificial Sequence; identical to SEQ ID NO: 9902
  Synthetic polypeptide

SEQ ID NO: 10323 - DNA, 247 bp, Artificial Sequence; identical to SEQ ID NO: 9903
  Synthetic polypeptide

SEQ ID NO: 10324 - DNA, 355 bp, Artificial Sequence; identical to SEQ ID NO: 9904
  Synthetic polypeptide

SEQ ID NO: 10325 - DNA, 368 bp, Artificial Sequence; identical to SEQ ID NO: 6482
  Synthetic polypeptide

SEQ ID NO: 10326 - DNA, 239 bp, Artificial Sequence
  Synthetic polypeptide
agccaccatgaactgtgtgccaggattaatgcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaa

SEQ ID NO: 10327 - DNA, 158 bp, Artificial Sequence; identical to SEQ ID NO: 7602
  Synthetic polypeptide

SEQ ID NO: 10328 - DNA, 1607 bp, Artificial Sequence
  Synthetic polypeptide
tgcggtaggcagctataatggccccccagagaggcccacatcctaatccctaaaacccgtgaatatgtctggttacaaggcaaaaaggactttgcaaatctttgcgaatgtgattaagcaaaggatcgtgagatggggatattctcccgatgatctggcttggccccatgttatcacaagggtccttataagtgaaaaaggagcagcagtgccagagtgaggagtgaggaagactctgcagccattgctggacttgaagacggaggaaggggctgtgagcccgggaatgcaagtgccctctaggaactggaaagggcaagaaaatggattctgccccagaccctcggggaggagtgcagacctgccaaccctcatttcaggcttccgatctccagaagcgtaaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtag

SEQ ID NO: 10329 - DNA, 698 bp, Artificial Sequence; identical to SEQ ID NO: 9922
  Synthetic polypeptide

SEQ ID NO: 10330 - DNA, 779 bp, Artificial Sequence; identical to SEQ ID NO: 9923
  Synthetic polypeptide

SEQ ID NO: 10331 - DNA, 1365 bp, Artificial Sequence; identical to SEQ ID NO: 8252
  Synthetic polypeptide

SEQ ID NO: 10332 - DNA, 773 bp, Artificial Sequence; identical to SEQ ID NO: 10251
  Synthetic polypeptide

SEQ ID NO: 10333 - DNA, 340 bp, Artificial Sequence; identical to SEQ ID NO: 8193
  Synthetic polypeptide

SEQ ID NO: 10334 - DNA, 330 bp, Artificial Sequence; identical to SEQ ID NO: 6490
  Synthetic polypeptide

SEQ ID NO: 10335 - DNA, 1537 bp, Artificial Sequence; identical to SEQ ID NO: 9702
  Synthetic polypeptide

SEQ ID NO: 10336 - DNA, 374 bp, Artificial Sequence
  Synthetic polypeptide
agcactgtccaatagaactttctgctgcgatggaaatgttccatctctgctctgtccagtacgttagccaccagccacatgtggcttttgagctcatgaaacatggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactga

SEQ ID NO: 10337 - DNA, 2471 bp, Artificial Sequence; identical to SEQ ID NO: 576
  Synthetic polypeptide

SEQ ID NO: 10338 - DNA, 494 bp, Artificial Sequence; identical to SEQ ID NO: 10040
  Synthetic polypeptide

SEQ ID NO: 10339 - DNA, 804 bp, Artificial Sequence; identical to SEQ ID NO: 10041
  Synthetic polypeptide

SEQ ID NO: 10340 - DNA, 1911 bp, Artificial Sequence; identical to SEQ ID NO: 10042
  Synthetic polypeptide

SEQ ID NO: 10341 - DNA, 531 bp, Artificial Sequence; identical to SEQ ID NO: 10043
  Synthetic polypeptide

SEQ ID NO: 10342 - DNA, 776 bp, Artificial Sequence; identical to SEQ ID NO: 7522
  Synthetic polypeptide

SEQ ID NO: 10343 - DNA, 548 bp, Artificial Sequence; identical to SEQ ID NO: 7523
  Synthetic polypeptide

SEQ ID NO: 10344 - DNA, 399 bp, Artificial Sequence
  Synthetic polypeptide
ggctgggctgaatggctcacgcctataatcccagcactttgggaagccaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatag

SEQ ID NO: 10345 - DNA, 138 bp, Artificial Sequence
  Synthetic polypeptide
ggctgggctgaatggctcacgcctataatcccagcactttgggaagccaaggtacttaaacttcacccttgtttagcccctattaaggttgctttggatgtaggaagaggccccacattggaactaagacaggtatga

SEQ ID NO: 10346 - DNA, 467 bp, Artificial Sequence
  Synthetic polypeptide
tgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtgg

SEQ ID NO: 10347 - DNA, 504 bp, Artificial Sequence
  Synthetic polypeptide
tgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgag

SEQ ID NO: 10348 - DNA, 777 bp, Artificial Sequence
  Synthetic polypeptide
tgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaaatataaagtcagacacagagacgttaaataa

SEQ ID NO: 10349 - DNA, 1884 bp, Artificial Sequence
  Synthetic polypeptide
tgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtga

SEQ ID NO: 10350 - DNA, 1349 bp, Artificial Sequence; identical to SEQ ID NO: 7130
  Synthetic polypeptide

SEQ ID NO: 10351 - DNA, 721 bp, Artificial Sequence; identical to SEQ ID NO: 10080
  Synthetic polypeptide

SEQ ID NO: 10352 - DNA, 706 bp, Artificial Sequence; identical to SEQ ID NO: 10081
  Synthetic polypeptide

SEQ ID NO: 10353 - DNA, 526 bp, Artificial Sequence; identical to SEQ ID NO: 10082
  Synthetic polypeptide

SEQ ID NO: 10354 - DNA, 487 bp, Artificial Sequence; identical to SEQ ID NO: 10083
  Synthetic polypeptide

SEQ ID NO: 10355 - DNA, 667 bp, Artificial Sequence; identical to SEQ ID NO: 10084
  Synthetic polypeptide

SEQ ID NO: 10356 - DNA, 592 bp, Artificial Sequence; identical to SEQ ID NO: 10085
  Synthetic polypeptide

SEQ ID NO: 10357 - DNA, 188 bp, Artificial Sequence
  Synthetic polypeptide
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggat

SEQ ID NO: 10358 - DNA, 1569 bp, Artificial Sequence
  Synthetic polypeptide
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtga

SEQ ID NO: 10359 - DNA, 338 bp, Artificial Sequence
  Synthetic polypeptide
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatga

SEQ ID NO: 10360 - DNA, 432 bp, Artificial Sequence
  Synthetic polypeptide
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccag

SEQ ID NO: 10361 - DNA, 237 bp, Artificial Sequence
  Synthetic polypeptide
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagt

SEQ ID NO: 10362 - DNA, 1530 bp, Artificial Sequence
  Synthetic polypeptide
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtga

SEQ ID NO: 10363 - DNA, 1615 bp, Artificial Sequence; identical to SEQ ID NO: 10001
  Synthetic polypeptide

SEQ ID NO: 10364 - DNA, 694 bp, Artificial Sequence; identical to SEQ ID NO: 10002
  Synthetic polypeptide

SEQ ID NO: 10365 - DNA, 333 bp, Artificial Sequence; identical to SEQ ID NO: 6583
  Synthetic polypeptide

SEQ ID NO: 10366 - DNA, 694 bp, Artificial Sequence; identical to SEQ ID NO: 10173
  Synthetic polypeptide

SEQ ID NO: 10367 - DNA, 760 bp, Artificial Sequence; identical to SEQ ID NO: 10174
  Synthetic polypeptide

SEQ ID NO: 10368 - DNA, 664 bp, Artificial Sequence; identical to SEQ ID NO: 10175
  Synthetic polypeptide

SEQ ID NO: 10369 - DNA, 1067 bp, Artificial Sequence; identical to SEQ ID NO: 9936
  Synthetic polypeptide

SEQ ID NO: 10370 - DNA, 968 bp, Artificial Sequence; identical to SEQ ID NO: 9937
  Synthetic polypeptide

SEQ ID NO: 10371 - DNA, 914 bp, Artificial Sequence
  Synthetic polypeptide
aagttaagcataaactagccatttgacctagcaattctagccctaggaatttatctagaagaaatgaaagcatgtgttccaaaaagacgtgtacataaatgttctcagcagcctcattcactataggcagcaactggaaacaacccaagtgtccgtcagctagagaatggatagacccatgtggtctgtgcatacagtggagtactgctcagttacacaaggaaaagaaactatggatacaggtcacaggagggatgatcttcaaaacattacaggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagattttaccatcacctgtccagggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgttcttctgaggacaacctgagtttagtatgcctaccacgaagtgaagatgatgactgtgatgatgatgatgatgatgcccagattttaccgtcacctgtccaggcttgttctgaagatagcctgtttttaagatgctcactgagacacaaagatgaagaagaagaagatgatgatgacatccacataacagctcggatagaaagtgacttgacgctggagagtctaagtgatgaagagattcatccagggtga

SEQ ID NO: 10372 - DNA, 6407 bp, Artificial Sequence
  Synthetic polypeptide
ctaggctgtaagctgaagaaaggaggggccagctctgtttttgctcacctttgtgttgccagcaccattttatctccaggcacgaaacagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcaggtacatttagagaagaacagaaatgtacataccaatttctgatgcaaggattcatctgcaaacagactgaccaagtggtcctaattcttgatagcgctgatgccatttgggcaattcagaagttatatccagttgtatctgtgactagtggttttgttgatgtctttagcagtgtaaatgccaatattccctgctctacttctgggtcagtgtctactttctattctatcttacccatcaggcaaatcaccaaagtctgcttcatggatcaaactcctcaagttttgcgcttttttctattggggaacaaaagtacctccaagcttctcttggctgtattctaccatgagctccagagcccccacgtcttcttaggggaaagttttattccacccactctggttcagtcagcttccttattgctgaatgaatctattggtgccaactatttcaacatcatggataacctcttgtatgttgtcctacaaggagaggagcccattgaaatacgctcaggtgtttccattcacttggccctcactgtgatggtttcagtcttagaaaaaggctgggaaatagtaatactcgaaagactaactaacttcttacagattggccaaaaccaaatcaggtttattcacgagatgcctggccatgaagagaccttaaaggccattgctgacagtagagcaaaaagaaagcgcaattgccctactgtgacttgcactagtcattatagaagagttggtcaacgtaggcctctcatgatggaaatgaactcacatagggcttcacccccaatgactgtggaaactatctcaaaagtgattgtcattgaaattggtgattcgccaacagtaaggagcactggaatgatttcatccttatcaagtaacaaattacagaatttggctcatcgagtcatcactgctcaacagactggggtactagagaatgttctgaatatgactatcggggccttactagttactcagtcaaagggagtcattggctatggaaatacaagcagttttaaaactgggaacttgatatatattcggccctatgcactttccatcctagtccagccttcagatggagaagtgggaaatgagcttccagtgcagccacaattggtatttttggatgagcagaatcgaagagtagagtccctgggacctccttcagagccatggacaatttcagcttccctggaaggagcatcagactcagtgctaaaagggtgcacccaggcagaaactcaagatggttatgttagcttctacaacttggcagtcttgatctctgggtcaaactggcactttatttttactgtcacttctcctccaggagtcaattttacagctcgatccaagccatttgctgtcttgcctgtgactaggaaggagaagtcgaccatcatcctggctgcttccctgtcctctgtggcctcatggctggctctgagctgtctggtgtgctgttggcttaaaagaagcaaaagcagaaaaacaaaacctgaagagattcctgaatcccagactaataatcaaaatattcatatccacatctcatccaaacgccgagaatcacaagggcccaaaaaagaagacactgtggtgggagaagatatgagaatgaaggtcatgctgggcaaggtgaaccagtgcccccaccagttgatgaatggagtgtccagaaggaaagttagccgccacattgtccgagaggaagaggctgctgtgcctgctcctggtactactggcatcacatcccatgggcacatctgtgctccaggtgctcctgctcagcaggtgtacctgcaagagactgggaactggaaggagggccaagagcagttgctcagataccagctggcaggccaaaatcagctgctgctgctatgcccagacttcagacaagagaggcagcagttgccagggcaaagtcggctgagtaagcaaagtggcagcttggggctttcccaagagaagaaagcctcctgcggggccactgaggcattctgccttcattcagtacacccggaaactattcaggagcaactgtga

SEQ ID NO: 10373 - DNA, 4373 bp, Artificial Sequence
  Synthetic polypeptide
ctaggctgtaagctgaagaaaggaggggccagctctgtttttgctcacctttgtgttgccagcaccattttatctccaggcacgaaacagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcagtaaccactgagcaggctttgaagatttcagaatag

SEQ ID NO: 10374 - DNA, 1447 bp, Artificial Sequence; identical to SEQ ID NO: 9968
  Synthetic polypeptide

SEQ ID NO: 10375 - DNA, 1828 bp, Artificial Sequence; identical to SEQ ID NO: 9969
  Synthetic polypeptide

SEQ ID NO: 10376 - DNA, 2436 bp, Artificial Sequence; identical to SEQ ID NO: 10006
  Synthetic polypeptide

SEQ ID NO: 10377 - DNA, 1956 bp, Artificial Sequence; identical to SEQ ID NO: 10007
  Synthetic polypeptide

SEQ ID NO: 10378 - DNA, 1307 bp, Artificial Sequence
  Synthetic polypeptide
ctcttcctctccctctccccacggtgtccctctctttccacggtctccctctctttccacggtctccctctcatgcggagccgaagctggactgtactgccgccatctcggctcactgcaacctccctgcctgattctcctgcctcagcctgccgagtgcctgcgattgcaggcacgcgccgccacgcctgactggttttggtggagacggggtttcgctgtgttggccgggcaggtctccagcccctaaccgcgagtgatccgccagcctcggcctcccgaggtgccgggattgcagacggagtctggttcactcagtgctcaatggtgcccaggctggagtgcagtggcgtgatctcggctcgctgcaacctccacctcccagccgtctgccttggcctcccaaagtgccgagattgcagcctctgcccggccgccaccccatctgggaagtgaggagtgtctctgcctggccgcgcatcgtctgggatgtgaggagcccctctgcctggctgcctagtctggaaagtgaggagcgtctccgcctggccgccatcccatctaggaagtgaggagcggcgcctcttcccggctgccatcacatctaggaagtgaggagcgtctctgcccggccgcccatcgtctgagatgtggggagcgcctctgccccgcctccccatctgggatgtgaggagcgcctctgcccggccgcaaccccgtctgggaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaa

SEQ ID NO: 10379 - DNA, 451 bp, Artificial Sequence
  Synthetic polypeptide
ctagaccaagattcgtcagctgcatgcttttggataagtgacttcccaacctggattctcgttttcttctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctga

SEQ ID NO: 10380 - DNA, 1085 bp, Artificial Sequence; identical to SEQ ID NO: 10247
  Synthetic polypeptide

SEQ ID NO: 10381 - DNA, 400 bp, Artificial Sequence; identical to SEQ ID NO: 749
  Synthetic polypeptide

SEQ ID NO: 10382 - DNA, 2301 bp, Artificial Sequence; identical to SEQ ID NO: 750
  Synthetic polypeptide

SEQ ID NO: 10383 - DNA, 2381 bp, Artificial Sequence; identical to SEQ ID NO: 751
  Synthetic polypeptide

SEQ ID NO: 10384 - DNA, 692 bp, Artificial Sequence; identical to SEQ ID NO: 752
  Synthetic polypeptide

SEQ ID NO: 10385 - DNA, 2737 bp, Artificial Sequence
  Synthetic polypeptide
gaattggaaatccttggacctcagttcctggcccaattctgcttctaacttgctttctaaccttgggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaa

SEQ ID NO: 10386 - DNA, 1779 bp, Artificial Sequence
  Synthetic polypeptide
ctactttgggccatgatggagccacagggactggatttgccctgccagtggttttcagatgttgaatgtaggcagtgtaggacagattcttcggaaaaaactaatgacatacgccctgtgattgctgcagcttactgtctggagagattcaagactgctgtgcagagagggagcacccaaatagagcctggcagtcttcctgagtcacggagacagagttcagaatttgagaaggccaagacctgccagctttttataaatgctgcagttgactctcctgcaattgattaccacatatctttagcccagagtgctttgcaaatctgcctgacacatcctgagctgcagaatgaaatttgctgtcagcttattaaacagacaagacgaagacagccacagaatcaaccaggaccattgcagggctggcagctcttggcactctgcgttgggctcttccttccccatcatcctttcctgtggctcctcaggcttcacctaaagaggaatgcagattccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaatttttgaatactttgaaccaggacacaggaatgaggaaaccagcgcagtctggatttgcgttgttcactgacgatccttctggcagagatttagagcattgtcttcaaggaaacatcaagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctga

SEQ ID NO: 10387 - DNA, 577 bp, Artificial Sequence; identical to SEQ ID NO: 10248
  Synthetic polypeptide

SEQ ID NO: 10388 - DNA, 916 bp, Artificial Sequence; identical to SEQ ID NO: 7516
  Synthetic polypeptide

SEQ ID NO: 10389 - DNA, 157 bp, Artificial Sequence; identical to SEQ ID NO: 7517
  Synthetic polypeptide

SEQ ID NO: 10390 - DNA, 424 bp, Artificial Sequence; identical to SEQ ID NO: 7518
  Synthetic polypeptide

SEQ ID NO: 10391 - DNA, 675 bp, Artificial Sequence; identical to SEQ ID NO: 7519
  Synthetic polypeptide

SEQ ID NO: 10392 - DNA, 282 bp, Artificial Sequence
  Synthetic polypeptide
tgacatagtttggatatttgttttctctaaatctcatgttgaaatgtaatccacagagttggaggtagggcctggtggaagacatttggatcatacgggcaggtcccacacgaatgacttagcaccatccccttcgttatgagctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtgg

SEQ ID NO: 10393 - DNA, 592 bp, Artificial Sequence
  Synthetic polypeptide
tgacatagtttggatatttgttttctctaaatctcatgttgaaatgtaatccacagagttggaggtagggcctggtggaagacatttggatcatacgggcaggtcccacacgaatgacttagcaccatccccttcgttatgagctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaaatataaagtcagacacagagacgttaaataa

SEQ ID NO: 10394 - DNA, 1699 bp, Artificial Sequence
  Synthetic polypeptide
tgacatagtttggatatttgttttctctaaatctcatgttgaaatgtaatccacagagttggaggtagggcctggtggaagacatttggatcatacgggcaggtcccacacgaatgacttagcaccatccccttcgttatgagctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtga

SEQ ID NO: 10395 - DNA, 319 bp, Artificial Sequence
  Synthetic polypeptide
tgacatagtttggatatttgttttctctaaatctcatgttgaaatgtaatccacagagttggaggtagggcctggtggaagacatttggatcatacgggcaggtcccacacgaatgacttagcaccatccccttcgttatgagctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgag

SEQ ID NO: 10396 - DNA, 942 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 10397 - DNA, 390 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 10398 - DNA, 206 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 10399 - DNA, 483 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 10400 - DNA, 978 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 10401 - DNA, 897 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 10402 - DNA, 660 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 10403 - DNA, 576 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 10404 - DNA, 639 bp, Artificial Sequence
  Synthetic polypeptide
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 10405 - DNA, 706 bp, Artificial Sequence; identical to SEQ ID NO: 10181
  Synthetic polypeptide

SEQ ID NO: 10406 - DNA, 386 bp, Artificial Sequence; identical to SEQ ID NO: 10182
  Synthetic polypeptide

SEQ ID NO: 10407 - DNA, 75 bp, Artificial Sequence; identical to SEQ ID NO: 10183
  Synthetic polypeptide

SEQ ID NO: 10408 - DNA, 1911 bp, Artificial Sequence; identical to SEQ ID NO: 10254
  Synthetic polypeptide

SEQ ID NO: 10409 - DNA, 804 bp, Artificial Sequence; identical to SEQ ID NO: 10255
  Synthetic polypeptide

SEQ ID NO: 10410 - DNA, 531 bp, Artificial Sequence; identical to SEQ ID NO: 10256
  Synthetic polypeptide

SEQ ID NO: 10411 - DNA, 494 bp, Artificial Sequence; identical to SEQ ID NO: 10257
  Synthetic polypeptide

SEQ ID NO: 10412 - DNA, 1691 bp, Artificial Sequence; identical to SEQ ID NO: 7480
  Synthetic polypeptide

SEQ ID NO: 10413 - DNA, 1727 bp, Artificial Sequence; identical to SEQ ID NO: 7481
  Synthetic polypeptide

SEQ ID NO: 10414 - DNA, 629 bp, Artificial Sequence; identical to SEQ ID NO: 7482
  Synthetic polypeptide

SEQ ID NO: 10415 - DNA, 1553 bp, Artificial Sequence; identical to SEQ ID NO: 7483
  Synthetic polypeptide

SEQ ID NO: 10416 - DNA, 164 bp, Artificial Sequence; identical to SEQ ID NO: 831
  Synthetic polypeptide

SEQ ID NO: 10417 - DNA, 193 bp, Artificial Sequence; identical to SEQ ID NO: 834
  Synthetic polypeptide

SEQ ID NO: 10418 - DNA, 2287 bp, Artificial Sequence; identical to SEQ ID NO: 6799
  Synthetic polypeptide

SEQ ID NO: 10419 - DNA, 2234 bp, Artificial Sequence; identical to SEQ ID NO: 6800
  Synthetic polypeptide

SEQ ID NO: 10420 - DNA, 1195 bp, Artificial Sequence; identical to SEQ ID NO: 10074
  Synthetic polypeptide

SEQ ID NO: 10421 - DNA, 553 bp, Artificial Sequence; identical to SEQ ID NO: 10075
  Synthetic polypeptide

SEQ ID NO: 10422 - DNA, 1052 bp, Artificial Sequence; identical to SEQ ID NO: 447
  Synthetic polypeptide

SEQ ID NO: 10423 - DNA, 1118 bp, Artificial Sequence; identical to SEQ ID NO: 448
  Synthetic polypeptide

SEQ ID NO: 10424 - DNA, 2056 bp, Artificial Sequence; identical to SEQ ID NO: 522
  Synthetic polypeptide

SEQ ID NO: 10425 - DNA, 2098 bp, Artificial Sequence; identical to SEQ ID NO: 523
  Synthetic polypeptide

SEQ ID NO: 10426 - DNA, 372 bp, Artificial Sequence; identical to SEQ ID NO: 521
  Synthetic polypeptide

SEQ ID NO: 10427 - DNA, 1269 bp, Artificial Sequence; identical to SEQ ID NO: 616
  Synthetic polypeptide

SEQ ID NO: 10428 - DNA, 1134 bp, Artificial Sequence; identical to SEQ ID NO: 617
  Synthetic polypeptide

SEQ ID NO: 10429 - DNA, 501 bp, Artificial Sequence; identical to SEQ ID NO: 618
  Synthetic polypeptide

SEQ ID NO: 10430 - DNA, 1321 bp, Artificial Sequence; identical to SEQ ID NO: 619
  Synthetic polypeptide

SEQ ID NO: 10431 - DNA, 1197 bp, Artificial Sequence; identical to SEQ ID NO: 620
  Synthetic polypeptide

SEQ ID NO: 10432 - DNA, 1203 bp, Artificial Sequence; identical to SEQ ID NO: 621
  Synthetic polypeptide

SEQ ID NO: 10433 - DNA, 1131 bp, Artificial Sequence; identical to SEQ ID NO: 622
  Synthetic polypeptide

SEQ ID NO: 10434 - DNA, 642 bp, Artificial Sequence; identical to SEQ ID NO: 623
  Synthetic polypeptide

SEQ ID NO: 10435 - DNA, 977 bp, Artificial Sequence
  Synthetic polypeptide
tacaggacagtggttaactaggaggatacattccaggcctggcccaaatgcctgatccatccctctccagctttgtcacctttggcaaggtgctgtttgccctgaaccaaaccctgctgcagcaggagagtgtgcgggccgggagcctgcaggcctcctacaccacggaggacctcatcaagcactacaactgcggagacctcagcgcagtcatcttcaaccacgacacatcccagctgcccaactttatcaacaccaccctcccgccacacgagcaggtgacggcccaggagattgacagctacttccgccaggagctcatctacaagaggaatgagcgcatggggaagagggtcatggcgcttctacgggagaacgaggacaagatctgcttctttgccttcggagcaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccgcggcagttcaatgacctctgggtccgcatcgaggacagcaccaccgcctcaccacccccgctgcccctgcagcccacccacagctcggggaccgccaagccccccttccagctttcagaccagctacaacagcaggacccgccagggcccgccagcagctcggcacccaccctgggccttctccccgccatcgccaccaccatcgctgtctgcttcctgctgcatagccttgggccctcctga

SEQ ID NO: 10436 - DNA, 1211 bp, Artificial Sequence; identical to SEQ ID NO: 10032
  Synthetic polypeptide

SEQ ID NO: 10437 - DNA, 1100 bp, Artificial Sequence; identical to SEQ ID NO: 10033
  Synthetic polypeptide

SEQ ID NO: 10438 - DNA, 674 bp, Artificial Sequence; identical to SEQ ID NO: 10034
  Synthetic polypeptide

SEQ ID NO: 10439 - DNA, 2046 bp, Artificial Sequence; identical to SEQ ID NO: 9948
  Synthetic polypeptide

SEQ ID NO: 10440 - DNA, 1372 bp, Artificial Sequence
  Synthetic polypeptide
gtaatgggcagtaacatggaagatgggaatatgctacaacccatcgtttcttgtaaagaagcatctgctgcagctttgcaccaagagactcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggctgtttcctgccgtccttttccctttaa

SEQ ID NO: 10441 - DNA, 832 bp, Artificial Sequence
  Synthetic polypeptide
gtaatgggcagtaacatggaagatgggaatatgctacaacccatcgtttcttgtaaagaagcatctgctgcagctttgcaccaagagactcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtga

SEQ ID NO: 10442 - DNA, 1879 bp, Artificial Sequence
  Synthetic polypeptide
gtaatgggcagtaacatggaagatgggaatatgctacaacccatcgtttcttgtaaagaagcatctgctgcagctttgcaccaagagactcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggcctttggagcagcaggcctgagcagcgactacccactggctcagttcttcacctgggcccgagccctgcgctttgccgacggccctgacgaggtgcaccgggccacggtggccaagctagagctgaagcaccgcatttag

SEQ ID NO: 10443 - DNA, 218 bp, Artificial Sequence
  Synthetic polypeptide
gtaatgggcagtaacatggaagatgggaatatgctacaacccatcgtttcttgtaaagaagcatctgctgcagctttgcaccaagagactcaggctcgacaacctggtgtttcatccagaagagccagaggtgcttgctgtccttgactgggaactttctaccttgggcgacccccttgctgatgtggcctacagctgcctggctcattacctgccat

SEQ ID NO: 10444 - DNA, 451 bp, Artificial Sequence
  Synthetic polypeptide
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaat

SEQ ID NO: 10445 - DNA, 513 bp, Artificial Sequence
  Synthetic polypeptide
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaag

SEQ ID NO: 10446 - DNA, 289 bp, Artificial Sequence
  Synthetic polypeptide
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggag

SEQ ID NO: 10447 - DNA, 124 bp, Artificial Sequence
  Synthetic polypeptide
actggaaggcagaagccacgcagacttctagtcctggttccactgcttactcggccacggccacccagaggccaactccaatgagaagcatccatcccagcaggacacgcggcctgctgaacag

SEQ ID NO: 10448 - DNA, 2593 bp, Artificial Sequence
  Synthetic polypeptide
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 10449 - DNA, 2590 bp, Artificial Sequence
  Synthetic polypeptide
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 10450 - DNA, 524 bp, Artificial Sequence
  Synthetic polypeptide
gccaggtgcagcagtgtgtgcctgtagtcccagccacttgggaggtggagattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaa

SEQ ID NO: 10451 - DNA, 1319 bp, Artificial Sequence; identical to SEQ ID NO: 10058
  Synthetic polypeptide

SEQ ID NO: 10452 - DNA, 1193 bp, Artificial Sequence; identical to SEQ ID NO: 10059
  Synthetic polypeptide

SEQ ID NO: 10453 - DNA, 473 bp, Artificial Sequence; identical to SEQ ID NO: 10060
  Synthetic polypeptide

SEQ ID NO: 10454 - DNA, 302 bp, Artificial Sequence; identical to SEQ ID NO: 10061
  Synthetic polypeptide

SEQ ID NO: 10455 - DNA, 588 bp, Artificial Sequence; identical to SEQ ID NO: 8704
  Synthetic polypeptide

SEQ ID NO: 10456 - DNA, 585 bp, Artificial Sequence; identical to SEQ ID NO: 8705
  Synthetic polypeptide

SEQ ID NO: 10457 - DNA, 606 bp, Artificial Sequence; identical to SEQ ID NO: 8706
  Synthetic polypeptide

SEQ ID NO: 10458 - DNA, 384 bp, Artificial Sequence; identical to SEQ ID NO: 8707
  Synthetic polypeptide

SEQ ID NO: 10459 - DNA, 193 bp, Artificial Sequence; identical to SEQ ID NO: 8708
  Synthetic polypeptide

SEQ ID NO: 10460 - DNA, 170 bp, Artificial Sequence; identical to SEQ ID NO: 8709
  Synthetic polypeptide

SEQ ID NO: 10461 - DNA, 193 bp, Artificial Sequence; identical to SEQ ID NO: 7535
  Synthetic polypeptide

SEQ ID NO: 10462 - DNA, 1066 bp, Artificial Sequence; identical to SEQ ID NO: 7536
  Synthetic polypeptide

SEQ ID NO: 10463 - DNA, 1063 bp, Artificial Sequence; identical to SEQ ID NO: 7537
  Synthetic polypeptide

SEQ ID NO: 10464 - DNA, 404 bp, Artificial Sequence; identical to SEQ ID NO: 7538
  Synthetic polypeptide

SEQ ID NO: 10465 - DNA, 925 bp, Artificial Sequence; identical to SEQ ID NO: 7539
  Synthetic polypeptide

SEQ ID NO: 10466 - DNA, 1093 bp, Artificial Sequence; identical to SEQ ID NO: 7540
  Synthetic polypeptide

SEQ ID NO: 10467 - DNA, 261 bp, Artificial Sequence; identical to SEQ ID NO: 8717
  Synthetic polypeptide

SEQ ID NO: 10468 - DNA, 233 bp, Artificial Sequence; identical to SEQ ID NO: 8718
  Synthetic polypeptide

SEQ ID NO: 10469 - DNA, 168 bp, Artificial Sequence; identical to SEQ ID NO: 8710
  Synthetic polypeptide

SEQ ID NO: 10470 - DNA, 1290 bp, Artificial Sequence; identical to SEQ ID NO: 6392
  Synthetic polypeptide

SEQ ID NO: 10471 - DNA, 1130 bp, Artificial Sequence; identical to SEQ ID NO: 8820
  Synthetic polypeptide

SEQ ID NO: 10472 - DNA, 1280 bp, Artificial Sequence; identical to SEQ ID NO: 8821
  Synthetic polypeptide

SEQ ID NO: 10473 - DNA, 1277 bp, Artificial Sequence; identical to SEQ ID NO: 8822
  Synthetic polypeptide

SEQ ID NO: 10474 - DNA, 900 bp, Artificial Sequence; identical to SEQ ID NO: 8926
  Synthetic polypeptide

SEQ ID NO: 10475 - DNA, 831 bp, Artificial Sequence; identical to SEQ ID NO: 8927
  Synthetic polypeptide

SEQ ID NO: 10476 - DNA, 354 bp, Artificial Sequence; identical to SEQ ID NO: 8928
  Synthetic polypeptide

SEQ ID NO: 10477 - DNA, 175 bp, Artificial Sequence; identical to SEQ ID NO: 8766
  Synthetic polypeptide

SEQ ID NO: 10478 - DNA, 214 bp, Artificial Sequence; identical to SEQ ID NO: 8767
  Synthetic polypeptide

SEQ ID NO: 10479 - DNA, 1227 bp, Artificial Sequence
  Synthetic polypeptide
tggttctcatccagaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtga

SEQ ID NO: 10480 - DNA, 348 bp, Artificial Sequence; identical to SEQ ID NO: 6363
  Synthetic polypeptide

SEQ ID NO: 10481 - DNA, 932 bp, Artificial Sequence; identical to SEQ ID NO: 8873
  Synthetic polypeptide

SEQ ID NO: 10482 - DNA, 863 bp, Artificial Sequence; identical to SEQ ID NO: 8874
  Synthetic polypeptide

SEQ ID NO: 10483 - DNA, 386 bp, Artificial Sequence; identical to SEQ ID NO: 8875
  Synthetic polypeptide

SEQ ID NO: 10484 - DNA, 560 bp, Artificial Sequence; identical to SEQ ID NO: 6322
  Synthetic polypeptide

SEQ ID NO: 10485 - DNA, 181 bp, Artificial Sequence
  Synthetic polypeptide
caatacagtgtccccagcacggtgcctggcacaggcagggaaggaccccacgccctccatgctgggcctctgcggctccctggcctccattcccagctgcaagtccctggcgagcttcaaatccaacgagtgcctggtgagcgacagtcccgagggcagcccagcactgagccccagctga

SEQ ID NO: 10486 - DNA, 3311 bp, Artificial Sequence; identical to SEQ ID NO: 8841
  Synthetic polypeptide

SEQ ID NO: 10487 - DNA, 1586 bp, Artificial Sequence; identical to SEQ ID NO: 8842
  Synthetic polypeptide

SEQ ID NO: 10488 - DNA, 3044 bp, Artificial Sequence; identical to SEQ ID NO: 8843
  Synthetic polypeptide

SEQ ID NO: 10489 - DNA, 1740 bp, Artificial Sequence; identical to SEQ ID NO: 8844
  Synthetic polypeptide

SEQ ID NO: 10490 - DNA, 1708 bp, Artificial Sequence; identical to SEQ ID NO: 8845
  Synthetic polypeptide

SEQ ID NO: 10491 - DNA, 1597 bp, Artificial Sequence; identical to SEQ ID NO: 8846
  Synthetic polypeptide

SEQ ID NO: 10492 - DNA, 1571 bp, Artificial Sequence; identical to SEQ ID NO: 8847
  Synthetic polypeptide

SEQ ID NO: 10493 - DNA, 1562 bp, Artificial Sequence; identical to SEQ ID NO: 8848
  Synthetic polypeptide

SEQ ID NO: 10494 - DNA, 1518 bp, Artificial Sequence; identical to SEQ ID NO: 8849
  Synthetic polypeptide

SEQ ID NO: 10495 - DNA, 1451 bp, Artificial Sequence; identical to SEQ ID NO: 8850
  Synthetic polypeptide

SEQ ID NO: 10496 - DNA, 29 bp, Artificial Sequence
  Synthetic polypeptide
agaccctgagcctaggaaccacagaataa

SEQ ID NO: 10497 - DNA, 546 bp, Artificial Sequence; identical to SEQ ID NO: 8836
  Synthetic polypeptide

SEQ ID NO: 10498 - DNA, 1293 bp, Artificial Sequence; identical to SEQ ID NO: 8745
  Synthetic polypeptide

SEQ ID NO: 10499 - DNA, 471 bp, Artificial Sequence
  Synthetic polypeptide
ggagccaagatggctgaataggaacagctccggtctacagctcccagcatcagcgatgcagaagatgggtgatttctgcatttccatctgagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccag

SEQ ID NO: 10500 - DNA, 395 bp, Artificial Sequence
  Synthetic polypeptide
gggggaccagggggagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccag

SEQ ID NO: 10501 - DNA, 839 bp, Artificial Sequence; identical to SEQ ID NO: 9123
  Synthetic polypeptide

SEQ ID NO: 10502 - DNA, 2104 bp, Artificial Sequence; identical to SEQ ID NO: 9015
  Synthetic polypeptide

SEQ ID NO: 10503 - DNA, 1292 bp, Artificial Sequence; identical to SEQ ID NO: 8770
  Synthetic polypeptide

SEQ ID NO: 10504 - DNA, 1082 bp, Artificial Sequence; identical to SEQ ID NO: 8771
  Synthetic polypeptide

SEQ ID NO: 10505 - DNA, 1262 bp, Artificial Sequence
  Synthetic polypeptide
tgtcccttgatcaacaatgatttgaactgtgcaagtccacttacattcaaattttcatctgcttctgccatccctgagacagcaagaccaacccctcctcttccttctcctcctcagcctccttaacgtgaagacaatgaggatgaagacttttatgatgagccacttccactaaacgaatagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttga

SEQ ID NO: 10506 - DNA, 216 bp, Artificial Sequence; identical to SEQ ID NO: 8799
  Synthetic polypeptide

SEQ ID NO: 10507 - DNA, 1314 bp, Artificial Sequence; identical to SEQ ID NO: 8892
  Synthetic polypeptide

SEQ ID NO: 10508 - DNA, 1374 bp, Artificial Sequence; identical to SEQ ID NO: 8893
  Synthetic polypeptide

SEQ ID NO: 10509 - DNA, 157 bp, Artificial Sequence; identical to SEQ ID NO: 8894
  Synthetic polypeptide

SEQ ID NO: 10510 - DNA, 490 bp, Artificial Sequence; identical to SEQ ID NO: 8895
  Synthetic polypeptide

SEQ ID NO: 10511 - DNA, 1497 bp, Artificial Sequence; identical to SEQ ID NO: 8896
  Synthetic polypeptide

SEQ ID NO: 10512 - DNA, 1191 bp, Artificial Sequence; identical to SEQ ID NO: 8897
  Synthetic polypeptide

SEQ ID NO: 10513 - DNA, 89 bp, Artificial Sequence; identical to SEQ ID NO: 9056
  Synthetic polypeptide

SEQ ID NO: 10514 - DNA, 267 bp, Artificial Sequence; identical to SEQ ID NO: 9057
  Synthetic polypeptide

SEQ ID NO: 10515 - DNA, 739 bp, Artificial Sequence; identical to SEQ ID NO: 9058
  Synthetic polypeptide

SEQ ID NO: 10516 - DNA, 460 bp, Artificial Sequence; identical to SEQ ID NO: 9059
  Synthetic polypeptide

SEQ ID NO: 10517 - DNA, 147 bp, Artificial Sequence; identical to SEQ ID NO: 9060
  Synthetic polypeptide

SEQ ID NO: 10518 - DNA, 147 bp, Artificial Sequence; identical to SEQ ID NO: 9061
  Synthetic polypeptide

SEQ ID NO: 10519 - DNA, 1272 bp, Artificial Sequence
  Synthetic polypeptide
agccccagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactga

SEQ ID NO: 10520 - DNA, 2046 bp, Artificial Sequence; identical to SEQ ID NO: 8788
  Synthetic polypeptide

SEQ ID NO: 10521 - DNA, 2100 bp, Artificial Sequence; identical to SEQ ID NO: 8789
  Synthetic polypeptide

SEQ ID NO: 10522 - DNA, 2124 bp, Artificial Sequence; identical to SEQ ID NO: 8790
  Synthetic polypeptide

SEQ ID NO: 10523 - DNA, 2100 bp, Artificial Sequence; identical to SEQ ID NO: 8791
  Synthetic polypeptide

SEQ ID NO: 10524 - DNA, 2016 bp, Artificial Sequence; identical to SEQ ID NO: 8792
  Synthetic polypeptide

SEQ ID NO: 10525 - DNA, 2124 bp, Artificial Sequence; identical to SEQ ID NO: 8793
  Synthetic polypeptide

SEQ ID NO: 10526 - DNA, 2007 bp, Artificial Sequence; identical to SEQ ID NO: 8794
  Synthetic polypeptide

SEQ ID NO: 10527 - DNA, 663 bp, Artificial Sequence; identical to SEQ ID NO: 8795
  Synthetic polypeptide

SEQ ID NO: 10528 - DNA, 1219 bp, Artificial Sequence; identical to SEQ ID NO: 8865
  Synthetic polypeptide

SEQ ID NO: 10529 - DNA, 1585 bp, Artificial Sequence; identical to SEQ ID NO: 8866
  Synthetic polypeptide

SEQ ID NO: 10530 - DNA, 1324 bp, Artificial Sequence; identical to SEQ ID NO: 8867
  Synthetic polypeptide

SEQ ID NO: 10531 - DNA, 1006 bp, Artificial Sequence; identical to SEQ ID NO: 8868
  Synthetic polypeptide

SEQ ID NO: 10532 - DNA, 1585 bp, Artificial Sequence; identical to SEQ ID NO: 8869
  Synthetic polypeptide

SEQ ID NO: 10533 - DNA, 3034 bp, Artificial Sequence; identical to SEQ ID NO: 8891
  Synthetic polypeptide

SEQ ID NO: 10534 - DNA, 921 bp, Artificial Sequence; identical to SEQ ID NO: 8805
  Synthetic polypeptide

SEQ ID NO: 10535 - DNA, 1583 bp, Artificial Sequence; identical to SEQ ID NO: 828
  Synthetic polypeptide

SEQ ID NO: 10536 - DNA, 1421 bp, Artificial Sequence; identical to SEQ ID NO: 829
  Synthetic polypeptide

SEQ ID NO: 10537 - DNA, 1365 bp, Artificial Sequence; identical to SEQ ID NO: 8252
  Synthetic polypeptide

SEQ ID NO: 10538 - DNA, 89 bp, Artificial Sequence; identical to SEQ ID NO: 9056
  Synthetic polypeptide

SEQ ID NO: 10539 - DNA, 267 bp, Artificial Sequence; identical to SEQ ID NO: 9057
  Synthetic polypeptide

SEQ ID NO: 10540 - DNA, 1595 bp, Artificial Sequence; identical to SEQ ID NO: 851
  Synthetic polypeptide

SEQ ID NO: 10541 - DNA, 1433 bp, Artificial Sequence; identical to SEQ ID NO: 852
  Synthetic polypeptide

SEQ ID NO: 10542 - DNA, 373 bp, Artificial Sequence; identical to SEQ ID NO: 8882
  Synthetic polypeptide

SEQ ID NO: 10543 - DNA, 383 bp, Artificial Sequence; identical to SEQ ID NO: 8883
  Synthetic polypeptide

SEQ ID NO: 10544 - DNA, 387 bp, Artificial Sequence; identical to SEQ ID NO: 8884
  Synthetic polypeptide

SEQ ID NO: 10545 - DNA, 412 bp, Artificial Sequence; identical to SEQ ID NO: 8885
  Synthetic polypeptide

SEQ ID NO: 10546 - DNA, 606 bp, Artificial Sequence; identical to SEQ ID NO: 8886
  Synthetic polypeptide

SEQ ID NO: 10547 - DNA, 500 bp, Artificial Sequence; identical to SEQ ID NO: 8887
  Synthetic polypeptide

SEQ ID NO: 10548 - DNA, 526 bp, Artificial Sequence; identical to SEQ ID NO: 8888
  Synthetic polypeptide

SEQ ID NO: 10549 - DNA, 555 bp, Artificial Sequence; identical to SEQ ID NO: 8889
  Synthetic polypeptide

SEQ ID NO: 10550 - DNA, 490 bp, Artificial Sequence; identical to SEQ ID NO: 8890
  Synthetic polypeptide

SEQ ID NO: 10551 - DNA, 1047 bp, Artificial Sequence; identical to SEQ ID NO: 8738
  Synthetic polypeptide

SEQ ID NO: 10552 - DNA, 807 bp, Artificial Sequence; identical to SEQ ID NO: 8837
  Synthetic polypeptide

SEQ ID NO: 10553 - DNA, 450 bp, Artificial Sequence; identical to SEQ ID NO: 8838
  Synthetic polypeptide

SEQ ID NO: 10554 - DNA, 495 bp, Artificial Sequence; identical to SEQ ID NO: 7842
  Synthetic polypeptide

SEQ ID NO: 10555 - DNA, 373 bp, Artificial Sequence; identical to SEQ ID NO: 7843
  Synthetic polypeptide

SEQ ID NO: 10556 - DNA, 1593 bp, Artificial Sequence; identical to SEQ ID NO: 870
  Synthetic polypeptide

SEQ ID NO: 10557 - DNA, 1431 bp, Artificial Sequence; identical to SEQ ID NO: 871
  Synthetic polypeptide

SEQ ID NO: 10558 - DNA, 1133 bp, Artificial Sequence; identical to SEQ ID NO: 7332
  Synthetic polypeptide

SEQ ID NO: 10559 - DNA, 1172 bp, Artificial Sequence; identical to SEQ ID NO: 7333
  Synthetic polypeptide

SEQ ID NO: 10560 - DNA, 173 bp, Artificial Sequence; identical to SEQ ID NO: 8912
  Synthetic polypeptide

SEQ ID NO: 10561 - DNA, 198 bp, Artificial Sequence; identical to SEQ ID NO: 8913
  Synthetic polypeptide

SEQ ID NO: 10562 - DNA, 851 bp, Artificial Sequence; identical to SEQ ID NO: 8914
  Synthetic polypeptide

SEQ ID NO: 10563 - DNA, 227 bp, Artificial Sequence; identical to SEQ ID NO: 8915
  Synthetic polypeptide

SEQ ID NO: 10564 - DNA, 550 bp, Artificial Sequence; identical to SEQ ID NO: 8852
  Synthetic polypeptide

SEQ ID NO: 10565 - DNA, 301 bp, Artificial Sequence; identical to SEQ ID NO: 8853
  Synthetic polypeptide

SEQ ID NO: 10566 - DNA, 295 bp, Artificial Sequence; identical to SEQ ID NO: 8854
  Synthetic polypeptide

SEQ ID NO: 10567 - DNA, 619 bp, Artificial Sequence; identical to SEQ ID NO: 8855
  Synthetic polypeptide

SEQ ID NO: 10568 - DNA, 833 bp, Artificial Sequence
  Synthetic polypeptide
cctcatctgccctcctctactactgattcttcccataatctctgaccccagctagatcgctggcctccttaccccgtccagttccttgtgactcgactggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtag

SEQ ID NO: 10569 - DNA, 336 bp, Artificial Sequence; identical to SEQ ID NO: 7520
  Synthetic polypeptide

SEQ ID NO: 10570 - DNA, 346 bp, Artificial Sequence; identical to SEQ ID NO: 7521
  Synthetic polypeptide

SEQ ID NO: 10571 - DNA, 1320 bp, Artificial Sequence; identical to SEQ ID NO: 8817
  Synthetic polypeptide

SEQ ID NO: 10572 - DNA, 420 bp, Artificial Sequence; identical to SEQ ID NO: 8818
  Synthetic polypeptide

SEQ ID NO: 10573 - DNA, 271 bp, Artificial Sequence; identical to SEQ ID NO: 8953
  Synthetic polypeptide

SEQ ID NO: 10574 - DNA, 60 bp, Artificial Sequence; identical to SEQ ID NO: 8954
  Synthetic polypeptide

SEQ ID NO: 10575 - DNA, 317 bp, Artificial Sequence
  Synthetic polypeptide
aactcagtaacactgagcatccctaccacccagattgtggtcttcaaataccattttccactcaaaagagtcaggtgtctttgggaaaatgactgagtccaggtttggagcagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttag

SEQ ID NO: 10576 - DNA, 226 bp, Artificial Sequence
  Synthetic polypeptide
gggaagctagaccagtggaatcaggcttggagtcaagagacatggttcaggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtga

SEQ ID NO: 10577 - DNA, 298 bp, Artificial Sequence
  Synthetic polypeptide
gggaagctagaccagtggaatcaggcttggagtcaagagacatggttcaggtggctcctgcacctgcgcggactcctgcaagtgcgagggatgcaaatgcacctcctgcaagaagagtgagtgcggggacccttcccctctgccgccgccccctctgctctgcggagtcggtgtctcaccacgcaggatgtggagagacagccaggccccgatcccgtggtttctgactcttgctggaatagaaccacccgggcagacattaaaatacagatgcccctgccccacacccaggaattga

SEQ ID NO: 10578 - DNA, 3977 bp, Artificial Sequence
  Synthetic polypeptide
ctagattatcatgctaaaccagccaatactaaaattgtttaaatatacaatttaaatgaactccatggtcttaagtcaaattacctgtgataactcagtagttatcactgctgtgcacctaaattggagaagcaactggcattcgagaggacataagttcagtgttaagcatggactcatgaagaaccaggacagccaccttatccttcccaagtccttaaagcttttgttattaaaggttctgcattccatgactcgccatggaaaagataaaataatccaaactgaatatattgatgtggtgacttatacattgtggaaatagtttaaaaccaatgtttggttccatatacctgggaagacagtcaaaactttaggtacatttgagtacctgatggtccatttaaacatttataaagggatttcattcaattgtcattttcagtgcatgttttctggttgtataaaagctttcccatgcaagagggctgttgttataacagtagattattatgctatagtgtattttcaccaggtaaataaagctttttatggttcactgataacaatccctttacaatctagaacccaaagattggatcttctgagaacatcagagaaagactgtccttaccatccacaccacagcaaaactttggagccttgaacattgggttcataatctcacagctgagaaaggtccctccacactcctggaactgtacacctattggaacccttaagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccaggcccccctgtcttccccctaaaccacagaaaatgaggagacctaggcctctctcagtgtatagccataaactctttaacggcagtatggaagcattcattaaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtga

SEQ ID NO: 10579 - DNA, 3905 bp, Artificial Sequence
  Synthetic polypeptide
ctagattatcatgctaaaccagccaatactaaaattgtttaaatatacaatttaaatgaactccatggtcttaagtcaaattacctgtgataactcagtagttatcactgctgtgcacctaaattggagaagcaactggcattcgagaggacataagttcagtgttaagcatggactcatgaagaaccaggacagccaccttatccttcccaagtccttaaagcttttgttattaaaggttctgcattccatgactcgccatggaaaagataaaataatccaaactgaatatattgatgtggtgacttatacattgtggaaatagtttaaaaccaatgtttggttccatatacctgggaagacagtcaaaactttaggtacatttgagtacctgatggtccatttaaacatttataaagggatttcattcaattgtcattttcagtgcatgttttctggttgtataaaagctttcccatgcaagagggctgttgttataacagtagattattatgctatagtgtattttcaccaggtaaataaagctttttatggttcactgataacaatccctttacaatctagaacccaaagattggatcttctgagaacatcagagaaagactgtccttaccatccacaccacagcaaaactttggagccttgaacattgggttcataatctcacagctgagaaaggtccctccacactcctggaactgtacacctattggaacccttaagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccagaggaagaagaaatgctcgaaccaggaaccaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtga

SEQ ID NO: 10580 - DNA, 514 bp, Artificial Sequence
  Synthetic polypeptide
gcagttaaacacttgggctccagaattggactgcacgactttactctccagcttaccacttgccagccgtgtgacacggaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaa

SEQ ID NO: 10581 - DNA, 860 bp, Artificial Sequence
  Synthetic polypeptide
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtag

SEQ ID NO: 10582 - DNA, 560 bp, Artificial Sequence
  Synthetic polypeptide
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggggactgccaagtgtgctttatagaaggctggaagaccgactga

SEQ ID NO: 10583 - DNA, 285 bp, Artificial Sequence
  Synthetic polypeptide
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcag

SEQ ID NO: 10584 - DNA, 252 bp, Artificial Sequence
  Synthetic polypeptide
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggc

SEQ ID NO: 10585 - DNA, 215 bp, Artificial Sequence
  Synthetic polypeptide
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtg

SEQ ID NO: 10586 - DNA, 1861 bp, Artificial Sequence; identical to SEQ ID NO: 6680
  Synthetic polypeptide

SEQ ID NO: 10587 - DNA, 1123 bp, Artificial Sequence; identical to SEQ ID NO: 6681
  Synthetic polypeptide

SEQ ID NO: 10588 - DNA, 148 bp, Artificial Sequence; identical to SEQ ID NO: 6388
  Synthetic polypeptide

SEQ ID NO: 10589 - DNA, 1100 bp, Artificial Sequence; identical to SEQ ID NO: 6389
  Synthetic polypeptide

SEQ ID NO: 10590 - DNA, 464 bp, Artificial Sequence; identical to SEQ ID NO: 6390
  Synthetic polypeptide

SEQ ID NO: 10591 - DNA, 280 bp, Artificial Sequence; identical to SEQ ID NO: 6391
  Synthetic polypeptide

SEQ ID NO: 10592 - DNA, 251 bp, Artificial Sequence
  Synthetic polypeptide
taattagttttgcagaagtgcagccatgttacatcactgctcaggaggtcatgcagttgcacattctgtactctacttttatgagagaaaagcacatggcaggaaggcaagctgatatcagggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10593 - DNA, 1555 bp, Artificial Sequence
  Synthetic polypeptide
ttatgttaaagaggcgatttttggaaagtcccagatagccactggatggggggctggttgccaggggaacaaacctggtgctctgagggttggaatttacaggcccacccctcacctctggggaagggagaggggatgaagattgagtagagcaccaattgccaatgatttaatcggtcatgcctgtgtaatgaagcctccataaaaatccaaaaggactgagtttgggggcttccaggaaggtgaacaagaacacatccacaggccaggagggtgcaaacccaacgccacagggcagcaactcctatgcgccggacccttctagagcttcccctcggtatctcttcatctggctgtttatttgtatcctttaaaatatcctttataacaaatggatgaacgtaagtaagtgtctccttgagttctgtgagctactctaacaaattaattgaacccaaggagcagtcctgagaacctcgatttatagctggttggtcagaggcacagataaaacaacctgaagcttgtgttggcattggaagtgggagagtcttgtgggactgagccttcactctgtgggatctgatgctatcttcagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtga

SEQ ID NO: 10594 - DNA, 678 bp, Artificial Sequence; identical to SEQ ID NO: 8918
  Synthetic polypeptide

SEQ ID NO: 10595 - DNA, 726 bp, Artificial Sequence; identical to SEQ ID NO: 8919
  Synthetic polypeptide

SEQ ID NO: 10596 - DNA, 949 bp, Artificial Sequence; identical to SEQ ID NO: 8902
  Synthetic polypeptide

SEQ ID NO: 10597 - DNA, 946 bp, Artificial Sequence; identical to SEQ ID NO: 8903
  Synthetic polypeptide

SEQ ID NO: 10598 - DNA, 967 bp, Artificial Sequence; identical to SEQ ID NO: 8904
  Synthetic polypeptide

SEQ ID NO: 10599 - DNA, 394 bp, Artificial Sequence; identical to SEQ ID NO: 8905
  Synthetic polypeptide

SEQ ID NO: 10600 - DNA, 435 bp, Artificial Sequence; identical to SEQ ID NO: 8906
  Synthetic polypeptide

SEQ ID NO: 10601 - DNA, 197 bp, Artificial Sequence; identical to SEQ ID NO: 8907
  Synthetic polypeptide

SEQ ID NO: 10602 - DNA, 1524 bp, Artificial Sequence
  Synthetic polypeptide
aggagcatactactgggacggaaggacctgaactttgagataagtctgggtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttga

SEQ ID NO: 10603 - DNA, 1509 bp, Artificial Sequence
  Synthetic polypeptide
aggagcatactactgggacggaaggacctgaactttgagataagtctgggtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgattaagtaa

SEQ ID NO: 10604 - DNA, 1515 bp, Artificial Sequence
  Synthetic polypeptide
aggagcatactactgggacggaaggacctgaactttgagataagtctgggtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtga

SEQ ID NO: 10605 - DNA, 244 bp, Artificial Sequence
  Synthetic polypeptide
gcgggcgggggtcggcgccccgagggctgcggggagccgccgggggtccggggcgcagggcgtgcgggcctggccgggccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatga

SEQ ID NO: 10606 - DNA, 467 bp, Artificial Sequence
  Synthetic polypeptide
gcgggcgggggtcggcgccccgagggctgcggggagccgccgggggtccggggcgcagggcgtgcgggcctggccgggccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtag

SEQ ID NO: 10607 - DNA, 1744 bp, Artificial Sequence
  Synthetic polypeptide
cccggacgccgcccccgaacgattaaagcagaagctgggatgtggggcccaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattag

SEQ ID NO: 10608 - DNA, 803 bp, Artificial Sequence
  Synthetic polypeptide
cccggacgccgcccccgaacgattaaagcagaagctgggatgtggggcccaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcaggcagagtaggtgtggagaaggcaaggctgtagctctatggtttttgatgaagcagctgggccagggagtgactgtggctctttgcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgg

SEQ ID NO: 10609 - DNA, 1595 bp, Artificial Sequence
  Synthetic polypeptide
tgcagccgaagttgcttcagggctaccagggcggtggaggtttgggggtggggcgaattttgcagaaacctctttgctcctctgctaggcatttgaaaacgtggcttgggtcaggcacaggcgcccccaccccccgggtcccaggtgttcttagattttccttggcattgatggaaaggtcactcgttccccacttccgccggcacatgcctggacaccaccatttgtttcgccgtcgccccgtatgcctccggtgacacacattcacaccatctgctgtgggatacgccagtgccacgcgtggtcacatggtctgcacctggcattcgccactgttcctgtttgcacgagccctgtaaagcgcggtcggctttccggagccccagggcttttagaagaggggtaggccactgctctttcaaaggaggagggaggcagagggttgaaggatcagtgaatttgcagctgacactaggcctcgagacctatgggatcattctttgctgcagcgaggccctgcctgcctcagcagatgtggcgagcccatcctatctcactcggtgggggccaaaatgggatctgaaggggtgtcctgagaacacagcaggcgtcctgaagctccccctccctccctcggtggaagtcagctcaaggagttcctgaggacaggactcctgggggtttggccctgggacaggacaagacacccgcggtcccctctcccacgctgccccaaactggaggccggatccagccgccgccgcgcctgcagctggagcctcgctgccgccgcgctgcggtggcgttctttaaaggggacccagcctgactgccaggagcagagttcgagtcgggccagccaatgcgcatgcgcgaggcgggagcggcttctcccgtcacagtggttcccacggttgtcttagaaagcagtcctcgaggcatggcaaagtaggagccctccatggcagtgcttgagtgtcggggctctgagtctccggcctgacctctccacgtggtcgacgggaacgtccccagatgccaggattcgcaaagggctgaccaggatggcgaaaccttaggcagagtccggggaaagcagcacggcatcccagcctcaggcctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 10610 - DNA, 1433 bp, Artificial Sequence
  Synthetic polypeptide
tgcagccgaagttgcttcagggctaccagggcggtggaggtttgggggtggggcgaattttgcagaaacctctttgctcctctgctaggcatttgaaaacgtggcttgggtcaggcacaggcgcccccaccccccgggtcccaggtgttcttagattttccttggcattgatggaaaggtcactcgttccccacttccgccggcacatgcctggacaccaccatttgtttcgccgtcgccccgtatgcctccggtgacacacattcacaccatctgctgtgggatacgccagtgccacgcgtggtcacatggtctgcacctggcattcgccactgttcctgtttgcacgagccctgtaaagcgcggtcggctttccggagccccagggcttttagaagaggggtaggccactgctctttcaaaggaggagggaggcagagggttgaaggatcagtgaatttgcagctgacactaggcctcgagacctatgggatcattctttgctgcagcgaggccctgcctgcctcagcagatgtggcgagcccatcctatctcactcggtgggggccaaaatgggatctgaaggggtgtcctgagaacacagcaggcgtcctgaagctccccctccctccctcggtggaagtcagctcaaggagttcctgaggacaggactcctgggggtttggccctgggacaggacaagacacccgcggtcccctctcccacgctgccccaaactggaggccggatccagccgccgccgcgcctgcagctggagcctcgctgccgccgcgctgcggtggcgttctttaaaggggacccagcctgactgccaggagcagagttcgagtcgggccagccaatgcgcatgcgcgaggcgggagcggcttctcccgtcacagtggttcccacggttgtcttagaaagcagtcctcgaggcatggcaaagtaggagccctccatggcagtgcttgagtgtcggggctctgagtctccggcctgacctctccacgtggtcgacgggaacgtccccagatgccaggattcgcaaagggctgaccaggatggcgaaaccttaggcagagtccggggaaagcagcacggcatcccagcctcaggcctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10611 - DNA, 1833 bp, Artificial Sequence; identical to SEQ ID NO: 8747
  Synthetic polypeptide

SEQ ID NO: 10612 - DNA, 1755 bp, Artificial Sequence; identical to SEQ ID NO: 8748
  Synthetic polypeptide

SEQ ID NO: 10613 - DNA, 89 bp, Artificial Sequence; identical to SEQ ID NO: 9056
  Synthetic polypeptide

SEQ ID NO: 10614 - DNA, 267 bp, Artificial Sequence; identical to SEQ ID NO: 9057
  Synthetic polypeptide

SEQ ID NO: 10615 - DNA, 739 bp, Artificial Sequence; identical to SEQ ID NO: 9058
  Synthetic polypeptide

SEQ ID NO: 10616 - DNA, 460 bp, Artificial Sequence; identical to SEQ ID NO: 9059
  Synthetic polypeptide

SEQ ID NO: 10617 - DNA, 147 bp, Artificial Sequence; identical to SEQ ID NO: 9060
  Synthetic polypeptide

SEQ ID NO: 10618 - DNA, 147 bp, Artificial Sequence; identical to SEQ ID NO: 9061
  Synthetic polypeptide

SEQ ID NO: 10619 - DNA, 185 bp, Artificial Sequence; identical to SEQ ID NO: 8880
  Synthetic polypeptide

SEQ ID NO: 10620 - DNA, 142 bp, Artificial Sequence; identical to SEQ ID NO: 8881
  Synthetic polypeptide

SEQ ID NO: 10621 - DNA, 869 bp, Artificial Sequence
  Synthetic polypeptide
gtttttttattttagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataa

SEQ ID NO: 10622 - DNA, 711 bp, Artificial Sequence
  Synthetic polypeptide
gtttttttattttagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattg

SEQ ID NO: 10623 - DNA, 419 bp, Artificial Sequence
  Synthetic polypeptide
gtttttttattttagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttgg

SEQ ID NO: 10624 - DNA, 252 bp, Artificial Sequence
  Synthetic polypeptide
gtttttttattttagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatg

SEQ ID NO: 10625 - DNA, 68 bp, Artificial Sequence
  Synthetic polypeptide
ttcatctagagatcgtaacagtacggacacagaagaacagttgcagtgatgtgcaggagagagactga

SEQ ID NO: 10626 - DNA, 1039 bp, Artificial Sequence
  Synthetic polypeptide
ttcatctagagatcgtaacagtacggacacagaagaacagttgcagtgatgtgcaggagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattga

SEQ ID NO: 10627 - DNA, 1871 bp, Artificial Sequence
  Synthetic polypeptide
agaatggcggagtggaaaagagtcctggatttgaagtaaacagatgagaattctagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataa

SEQ ID NO: 10628 - DNA, 1625 bp, Artificial Sequence
  Synthetic polypeptide
agaatggcggagtggaaaagagtcctggatttgaagtaaacagatgagaattctagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattga

SEQ ID NO: 10629 - DNA, 446 bp, Artificial Sequence
  Synthetic polypeptide
agaatggcggagtggaaaagagtcctggatttgaagtaaacagatgagaattctagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacat

SEQ ID NO: 10630 - DNA, 998 bp, Artificial Sequence; identical to SEQ ID NO: 8819
  Synthetic polypeptide

SEQ ID NO: 10631 - DNA, 1469 bp, Artificial Sequence
  Synthetic polypeptide
gccggaggggatggcttagtggtctaagcatcagatttgaaatacctagagtccctggaactgcaggtttgaatgtcagcagagtcaacccagctcatcattcttccaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaa

SEQ ID NO: 10632 - DNA, 1768 bp, Artificial Sequence; identical to SEQ ID NO: 9894
  Synthetic polypeptide

SEQ ID NO: 10633 - DNA, 955 bp, Artificial Sequence; identical to SEQ ID NO: 9895
  Synthetic polypeptide

SEQ ID NO: 10634 - DNA, 978 bp, Artificial Sequence; identical to SEQ ID NO: 9896
  Synthetic polypeptide

SEQ ID NO: 10635 - DNA, 871 bp, Artificial Sequence; identical to SEQ ID NO: 9897
  Synthetic polypeptide

SEQ ID NO: 10636 - DNA, 1342 bp, Artificial Sequence
  Synthetic polypeptide
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaa

SEQ ID NO: 10637 - DNA, 1231 bp, Artificial Sequence
  Synthetic polypeptide
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaa

SEQ ID NO: 10638 - DNA, 145 bp, Artificial Sequence
  Synthetic polypeptide
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaac

SEQ ID NO: 10639 - DNA, 1441 bp, Artificial Sequence
  Synthetic polypeptide
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagtgtgtgtttactgtcacaaaggcacattttcagacccctactcctgtggtgacggacaccctgagggtccccatggcaggactggccttttcccatcaactctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaa

SEQ ID NO: 10640 - DNA, 384 bp, Artificial Sequence
  Synthetic polypeptide
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccag

SEQ ID NO: 10641 - DNA, 1476 bp, Artificial Sequence
  Synthetic polypeptide
tgtaggattccactgatatgacgtacctggagtcagcagagccacagagacagatggtagaatgcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctga

SEQ ID NO: 10642 - DNA, 381 bp, Artificial Sequence
  Synthetic polypeptide
tgtaggattccactgatatgacgtacctggagtcagcagagccacagagacagatggtagaatgcccgcagggccccggaccccggcttccaggagcgcttcttccagcagcgtctggaccacttcaacttcgagcgcttcggcaacaagaccttccctcagcgcttcctggtgtcgggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctga

SEQ ID NO: 10643 - DNA, 823 bp, Artificial Sequence
  Synthetic polypeptide
tgtaggattccactgatatgacgtacctggagtcagcagagccacagagacagatggtagaatgcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaggaagccctcccacctgtcctcccagccacctgctcagcttggatgtgcggccacactagcggcctttcccagtgagagctgcacccgcacctggcccagggttggaatttgtgggtctcagaagtgtcgtcctccttgtggcacctgtgggcccctgaggaggaaaagaggaaatggggtgttgggggcagcagccctaaccctgtgtccctcacccagttatggggggatgctcagtgcctacctgaggatgaagtatccccacctggtggcgggggcgctggcggccagcgcgcccgttctagctgtggcaggcctcggcgactccaaccagttcttcc

SEQ ID NO: 10644 - DNA, 818 bp, Artificial Sequence
  Synthetic polypeptide
agagtctgcgtggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataa

SEQ ID NO: 10645 - DNA, 749 bp, Artificial Sequence
  Synthetic polypeptide
agagtctgcgtggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaa

SEQ ID NO: 10646 - DNA, 272 bp, Artificial Sequence
  Synthetic polypeptide
agagtctgcgtggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggca

SEQ ID NO: 10647 - DNA, 354 bp, Artificial Sequence; identical to SEQ ID NO: 8772
  Synthetic polypeptide

SEQ ID NO: 10648 - DNA, 354 bp, Artificial Sequence; identical to SEQ ID NO: 8773
  Synthetic polypeptide

SEQ ID NO: 10649 - DNA, 871 bp, Artificial Sequence; identical to SEQ ID NO: 437
  Synthetic polypeptide

SEQ ID NO: 10650 - DNA, 421 bp, Artificial Sequence; identical to SEQ ID NO: 441
  Synthetic polypeptide

SEQ ID NO: 10651 - DNA, 638 bp, Artificial Sequence; identical to SEQ ID NO: 442
  Synthetic polypeptide

SEQ ID NO: 10652 - DNA, 337 bp, Artificial Sequence; identical to SEQ ID NO: 443
  Synthetic polypeptide

SEQ ID NO: 10653 - DNA, 1142 bp, Artificial Sequence
  Synthetic polypeptide
gctacctcctgctcatcttttgattctcactcagacttcacctactccaggaagccttccttgacctctgacctccctgggactggattgggctccctcttgtgtgctcccacagcaaccatcactctgaactgtgattgctggttactaatctgtcttgagcaccaccgtatccctccctgtgcctgatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgttt

SEQ ID NO: 10654 - DNA, 1109 bp, Artificial Sequence
  Synthetic polypeptide
gctacctcctgctcatcttttgattctcactcagacttcacctactccaggaagccttccttgacctctgacctccctgggactggattgggctccctcttgtgtgctcccacagcaaccatcactctgaactgtgattgctggttactaatctgtcttgagcaccaccgtatccctccctgtgcctgatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctga

SEQ ID NO: 10655 - DNA, 433 bp, Artificial Sequence
  Synthetic polypeptide
caaggctgctgcgtgtgatcgtggagatgtcccctgcaccaggatgctggccacaggggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctga

SEQ ID NO: 10656 - DNA, 525 bp, Artificial Sequence; identical to SEQ ID NO: 9033
  Synthetic polypeptide

SEQ ID NO: 10657 - DNA, 342 bp, Artificial Sequence; identical to SEQ ID NO: 9034
  Synthetic polypeptide

SEQ ID NO: 10658 - DNA, 1295 bp, Artificial Sequence; identical to SEQ ID NO: 8778
  Synthetic polypeptide

SEQ ID NO: 10659 - DNA, 738 bp, Artificial Sequence
  Synthetic polypeptide
acggtttgaagccaggactgctgggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctga

SEQ ID NO: 10660 - DNA, 633 bp, Artificial Sequence
  Synthetic polypeptide
acggtttgaagccaggactgctgggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctga

SEQ ID NO: 10661 - DNA, 1009 bp, Artificial Sequence
  Synthetic polypeptide
gaggcagtctggtggtctggttagagtgctgctcctggagccggacacctgggcacgaagctcagcccccacccctcaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagtaggacgcctcgtctaa

SEQ ID NO: 10662 - DNA, 1006 bp, Artificial Sequence
  Synthetic polypeptide
gaggcagtctggtggtctggttagagtgctgctcctggagccggacacctgggcacgaagctcagcccccacccctcaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaa

SEQ ID NO: 10663 - DNA, 1639 bp, Artificial Sequence
  Synthetic polypeptide
tgctgagaaccaggcagtgggagccctctgttccaggggcaggcacagaaggaggcattgtttgcagatgacagaaaaacaagaagagaacccagtctgcttttcactatcaccgtgtgctgacaattctaaacaatgtgggtgatttattgttctaagttccaaataactactgtggttatctgagcttcagtgggcacattcctatctcttgggctttactaacccttgtacttggaagttcatccagagaactcacaacgatactgggggctgctctcacatactcactttgcaggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctga

SEQ ID NO: 10664 - DNA, 215 bp, Artificial Sequence
  Synthetic polypeptide
aggcctcagcttgaaggtcccctctcccaggaagccttccctaacttcctgccacactcacatagttcctggcacttgacacccagttgctgatgggtaaccgacgccactcgctgagccctgaggagtatatttttggagccctcaacatttacctagacatcatctatatcttcaccttcttcctgcagctttttggcactaaccgagaatga

SEQ ID NO: 10665 - DNA, 188 bp, Artificial Sequence
  Synthetic polypeptide
aggcctcagcttgaaggtcccctctcccaggaagccttccctaacttcctgccacactcacatagttcctggcacttgacacccagttgctgatgggtaaccgacgccactcgctgagccctgaggagtatatttttggagccctcaacatttacctagacatcatctatatcttcaccttcttcctg

SEQ ID NO: 10666 - DNA, 146 bp, Artificial Sequence
  Synthetic polypeptide
aggcctcagcttgaaggtcccctctcccaggaagccttccctaacttcctgccacactcacatagttcctggcacttgacacccagttgctgatgggtaaccgacgccactcgctgagccctgaggagtatatttttggagccctc

SEQ ID NO: 10667 - DNA, 2333 bp, Artificial Sequence; identical to SEQ ID NO: 7950
  Synthetic polypeptide

SEQ ID NO: 10668 - DNA, 3042 bp, Artificial Sequence; identical to SEQ ID NO: 8824
  Synthetic polypeptide

SEQ ID NO: 10669 - DNA, 3000 bp, Artificial Sequence
  Synthetic polypeptide
gcaaaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctag

SEQ ID NO: 10670 - DNA, 2931 bp, Artificial Sequence
  Synthetic polypeptide
gcaaaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctccttttattagagccatcccagtctgctggctgcagctccccgtcccagccccatatgtctgctgggggaaggactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctag

SEQ ID NO: 10671 - DNA, 857 bp, Artificial Sequence; identical to SEQ ID NO: 9022
  Synthetic polypeptide

SEQ ID NO: 10672 - DNA, 854 bp, Artificial Sequence; identical to SEQ ID NO: 9023
  Synthetic polypeptide

SEQ ID NO: 10673 - DNA, 875 bp, Artificial Sequence; identical to SEQ ID NO: 9024
  Synthetic polypeptide

SEQ ID NO: 10674 - DNA, 302 bp, Artificial Sequence; identical to SEQ ID NO: 9025
  Synthetic polypeptide

SEQ ID NO: 10675 - DNA, 343 bp, Artificial Sequence; identical to SEQ ID NO: 9026
  Synthetic polypeptide

SEQ ID NO: 10676 - DNA, 105 bp, Artificial Sequence; identical to SEQ ID NO: 9027
  Synthetic polypeptide

SEQ ID NO: 10677 - DNA, 1475 bp, Artificial Sequence; identical to SEQ ID NO: 8798
  Synthetic polypeptide

SEQ ID NO: 10678 - DNA, 2544 bp, Artificial Sequence
  Synthetic polypeptide
gggggaggagccaagatggccgaataggaacagctccggtctacagctcccagcgtgagcgacgcagaagacgggtgatttctgcatttccatctgaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatga

SEQ ID NO: 10679 - DNA, 611 bp, Artificial Sequence
  Synthetic polypeptide
gggggaggagccaagatggccgaataggaacagctccggtctacagctcccagcgtgagcgacgcagaagacgggtgatttctgcatttccatctgaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgcct

SEQ ID NO: 10680 - DNA, 735 bp, Artificial Sequence; identical to SEQ ID NO: 8720
  Synthetic polypeptide

SEQ ID NO: 10681 - DNA, 1959 bp, Artificial Sequence
  Synthetic polypeptide
aaggggcagccagacttggagtgagatgactgcagattggatctgggctgggacctcgctagctgtgcccttgggcaaggcactttgcctctctggcctccatttcctccctcatctgtaaaatatgtgttgaagaggaagggggaagcgataataaatctaccacgtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaa

SEQ ID NO: 10682 - DNA, 2031 bp, Artificial Sequence
  Synthetic polypeptide
aaggggcagccagacttggagtgagatgactgcagattggatctgggctgggacctcgctagctgtgcccttgggcaaggcactttgcctctctggcctccatttcctccctcatctgtaaaatatgtgttgaagaggaagggggaagcgataataaatctaccacgtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggggaaacttctctcctccacccacgcctgtctcgccaccccccacctgactgtcttgaatgttcccatcctgtgactcaagtgaggaacatgggttttggagatggattttggaggcagagggacctggattcaaatcccagccccaccaccgtcaacagcctgcacttcactgtaaactcggaatga

SEQ ID NO: 10683 - DNA, 113 bp, Artificial Sequence; identical to SEQ ID NO: 9062
  Synthetic polypeptide

SEQ ID NO: 10684 - DNA, 1865 bp, Artificial Sequence
  Synthetic polypeptide
gaacacttggcttccacacgtgtctcagacagagaagcttccttagtctccttgtttcacctcatgggtgggtggattgtctagaatgagtgctaggcgatcatgactggccttgtcttctaggacagatggtgtcccattacctctgcacgtcctgtctcacaaatgagggatatcctctcctctgctcgtaggtggactgactccctgaatcttttttctgtaacgaatgtcatgaaaccaaaggaacagggctgggcctggggatggggttgcggctgggtgcaggggaggttgcgtcagggctacctgggcggtggaggcttcggggtggggtgaatgttgcagagaactccttgctcctctggcaggcatttcaaaatgtggcttggactgaggcacaggcctcctccttgttcgcaggtgttctttgattttccttggcattcagggaaaagccacttgatccgcctttccaccaggcacatgcgtggacactaatgttggtttcatcattgcaacatatgcctccggtgacatacattcacaccatctgctgtgggatacgccagtgccacgcgtgatcgcattgtctccacctcggattctcaccgaccctgtttgcacctgtcctggaaagcggtgtctgctggcaggagccccacggcttttagaagtggggcacaccactgctctttcaacggaggagggaggcagagggctcactgatcagtgaacatttagctgacaccacgccttgagggccatgggatcattctgtgcagcagcgaggccctgcctgcctcaccagatgtgctgagcccttcctttctaaccaggaggggtccaaactaagatctgaagaggattcctgagaacccagcaggcgccttgaagctccccctccatcagtggaagtcggctcaaggaggtcctgaagactggactcctgggggtttggccctgggacaggatactcaaggccccttctcccacgccgccacaaactggacccctgaaccagccgccgccgtggcagcagcaggagcctcgccgccaccacggagcagtggcgttattgaaaggggacgcagcctaactgccaggagggaagcgcgagtcggcccagccaatgcgcatgcgcgaggcgcgagcggcttctcccattacagtggttcccacggttgtcttagaaacaagtcctcgaggcttggcaaagcgggagccttccgcggcagagcttgggtgtccgggctctgaggctccggtctgacctctccacggggtcgacgggaatgtctccggatgccaggagttgcaaagggcagacctagatgaggaaaccccaggcagagtcctggggaagcagcacggcatccgagcctcaggcttgcctggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 10685 - DNA, 1703 bp, Artificial Sequence
  Synthetic polypeptide
gaacacttggcttccacacgtgtctcagacagagaagcttccttagtctccttgtttcacctcatgggtgggtggattgtctagaatgagtgctaggcgatcatgactggccttgtcttctaggacagatggtgtcccattacctctgcacgtcctgtctcacaaatgagggatatcctctcctctgctcgtaggtggactgactccctgaatcttttttctgtaacgaatgtcatgaaaccaaaggaacagggctgggcctggggatggggttgcggctgggtgcaggggaggttgcgtcagggctacctgggcggtggaggcttcggggtggggtgaatgttgcagagaactccttgctcctctggcaggcatttcaaaatgtggcttggactgaggcacaggcctcctccttgttcgcaggtgttctttgattttccttggcattcagggaaaagccacttgatccgcctttccaccaggcacatgcgtggacactaatgttggtttcatcattgcaacatatgcctccggtgacatacattcacaccatctgctgtgggatacgccagtgccacgcgtgatcgcattgtctccacctcggattctcaccgaccctgtttgcacctgtcctggaaagcggtgtctgctggcaggagccccacggcttttagaagtggggcacaccactgctctttcaacggaggagggaggcagagggctcactgatcagtgaacatttagctgacaccacgccttgagggccatgggatcattctgtgcagcagcgaggccctgcctgcctcaccagatgtgctgagcccttcctttctaaccaggaggggtccaaactaagatctgaagaggattcctgagaacccagcaggcgccttgaagctccccctccatcagtggaagtcggctcaaggaggtcctgaagactggactcctgggggtttggccctgggacaggatactcaaggccccttctcccacgccgccacaaactggacccctgaaccagccgccgccgtggcagcagcaggagcctcgccgccaccacggagcagtggcgttattgaaaggggacgcagcctaactgccaggagggaagcgcgagtcggcccagccaatgcgcatgcgcgaggcgcgagcggcttctcccattacagtggttcccacggttgtcttagaaacaagtcctcgaggcttggcaaagcgggagccttccgcggcagagcttgggtgtccgggctctgaggctccggtctgacctctccacggggtcgacgggaatgtctccggatgccaggagttgcaaagggcagacctagatgaggaaaccccaggcagagtcctggggaagcagcacggcatccgagcctcaggcttgcctggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10686 - DNA, 989 bp, Artificial Sequence; identical to SEQ ID NO: 8968
  Synthetic polypeptide

SEQ ID NO: 10687 - DNA, 1675 bp, Artificial Sequence; identical to SEQ ID NO: 8776
  Synthetic polypeptide

SEQ ID NO: 10688 - DNA, 1675 bp, Artificial Sequence; identical to SEQ ID NO: 8777
  Synthetic polypeptide

SEQ ID NO: 10689 - DNA, 1950 bp, Artificial Sequence
  Synthetic polypeptide
aactttcaaagtcaaggataatccaaaacagcctgatctatcttggaagatactgagtttctcatccctgcagctgatagtgaaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactga

SEQ ID NO: 10690 - DNA, 2037 bp, Artificial Sequence
  Synthetic polypeptide
aactttcaaagtcaaggataatccaaaacagcctgatctatcttggaagatactgagtttctcatccctgcagctgatagtgaaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtga

SEQ ID NO: 10691 - DNA, 993 bp, Artificial Sequence
  Synthetic polypeptide
aactttcaaagtcaaggataatccaaaacagcctgatctatcttggaagatactgagtttctcatccctgcagctgatagtgaaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtga

SEQ ID NO: 10692 - DNA, 443 bp, Artificial Sequence
  Synthetic polypeptide
aactttcaaagtcaaggataatccaaaacagcctgatctatcttggaagatactgagtttctcatccctgcagctgatagtgaaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcac

SEQ ID NO: 10693 - DNA, 127 bp, Artificial Sequence
  Synthetic polypeptide
aactttcaaagtcaaggataatccaaaacagcctgatctatcttggaagatactgagtttctcatccctgcagctgatagtgaaaaggtagaaactgaggaccaggtgctggcaaccttctgtggca

SEQ ID NO: 10694 - DNA, 94 bp, Artificial Sequence
  Synthetic polypeptide
aactttcaaagtcaaggataatccaaaacagcctgatctatcttggaagatactgagtttctcatccctgcagctgatagtgaaaaggtagaaa

SEQ ID NO: 10695 - DNA, 635 bp, Artificial Sequence
  Synthetic polypeptide
gttctcacgtcttgtcctcgccgcactctgagcctctgcagggccgggctgtgcatttctcatcgctttacctcaccaacagcatgcccaccctggagcgcttccccatcagcttcaagacctacttctcagggaactacttccgccacatcgtgctgggggtgaacttcgcgggccgctacggtgcgctgggcatgagtcggcgcgaggacctgatgtacaagccgcccgccttccgcacgctcagcgagctcgtgctggacttcgaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaagattggcaaagggacgggccctccctctcccaccaaggaccggaagaaggatgtttcttccccgcagcgggcccagtccagcccccaccgcaggaacagccgcagtgaaagacggccctcgggtgacaagaagacttccgagcccaaagccatgccagaccttaacgggtaccagatccgggtctga

SEQ ID NO: 10696 - DNA, 664 bp, Artificial Sequence; identical to SEQ ID NO: 9017
  Synthetic polypeptide

SEQ ID NO: 10697 - DNA, 574 bp, Artificial Sequence; identical to SEQ ID NO: 9018
  Synthetic polypeptide

SEQ ID NO: 10698 - DNA, 652 bp, Artificial Sequence; identical to SEQ ID NO: 9019
  Synthetic polypeptide

SEQ ID NO: 10699 - DNA, 529 bp, Artificial Sequence; identical to SEQ ID NO: 9020
  Synthetic polypeptide

SEQ ID NO: 10700 - DNA, 445 bp, Artificial Sequence; identical to SEQ ID NO: 9021
  Synthetic polypeptide

SEQ ID NO: 10701 - DNA, 1310 bp, Artificial Sequence
  Synthetic polypeptide
tggtatggtttggctctgtgtccctacccaaatctccccttgaattgtaataatccccatgtgtcaagggtgggatgaggtggagataattaactcatgggggcagtttcccccatgttgtccttgtgatagtaattcattacaagatttgatggttttataatggttttgctcagttctcattcttctctttcctgccagcatgtaaagaaggacatgtttgcttactcttcctccatgattgttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaa

SEQ ID NO: 10702 - DNA, 1946 bp, Artificial Sequence; identical to SEQ ID NO: 10199
  Synthetic polypeptide

SEQ ID NO: 10703 - DNA, 2084 bp, Artificial Sequence; identical to SEQ ID NO: 10200
  Synthetic polypeptide

SEQ ID NO: 10704 - DNA, 786 bp, Artificial Sequence; identical to SEQ ID NO: 9118
  Synthetic polypeptide

SEQ ID NO: 10705 - DNA, 969 bp, Artificial Sequence; identical to SEQ ID NO: 9119
  Synthetic polypeptide

SEQ ID NO: 10706 - DNA, 91 bp, Artificial Sequence; identical to SEQ ID NO: 9120
  Synthetic polypeptide

SEQ ID NO: 10707 - DNA, 663 bp, Artificial Sequence; identical to SEQ ID NO: 9121
  Synthetic polypeptide

SEQ ID NO: 10708 - DNA, 846 bp, Artificial Sequence; identical to SEQ ID NO: 9122
  Synthetic polypeptide

SEQ ID NO: 10709 - DNA, 456 bp, Artificial Sequence; identical to SEQ ID NO: 9037
  Synthetic polypeptide

SEQ ID NO: 10710 - DNA, 776 bp, Artificial Sequence
  Synthetic polypeptide
ctgccctactagccatgtgacctgggctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctga

SEQ ID NO: 10711 - DNA, 659 bp, Artificial Sequence
  Synthetic polypeptide
ctgccctactagccatgtgacctgggctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctga

SEQ ID NO: 10712 - DNA, 536 bp, Artificial Sequence
  Synthetic polypeptide
ctgccctactagccatgtgacctgggctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaa

SEQ ID NO: 10713 - DNA, 1164 bp, Artificial Sequence; identical to SEQ ID NO: 7133
  Synthetic polypeptide

SEQ ID NO: 10714 - DNA, 376 bp, Artificial Sequence; identical to SEQ ID NO: 7134
  Synthetic polypeptide

SEQ ID NO: 10715 - DNA, 2084 bp, Artificial Sequence; identical to SEQ ID NO: 10260
  Synthetic polypeptide

SEQ ID NO: 10716 - DNA, 1946 bp, Artificial Sequence; identical to SEQ ID NO: 10261
  Synthetic polypeptide

SEQ ID NO: 10717 - DNA, 647 bp, Artificial Sequence; identical to SEQ ID NO: 10262
  Synthetic polypeptide

SEQ ID NO: 10718 - DNA, 182 bp, Artificial Sequence; identical to SEQ ID NO: 10263
  Synthetic polypeptide

SEQ ID NO: 10719 - DNA, 514 bp, Artificial Sequence; identical to SEQ ID NO: 9048
  Synthetic polypeptide

SEQ ID NO: 10720 - DNA, 475 bp, Artificial Sequence; identical to SEQ ID NO: 9049
  Synthetic polypeptide

SEQ ID NO: 10721 - DNA, 553 bp, Artificial Sequence; identical to SEQ ID NO: 9050
  Synthetic polypeptide

SEQ ID NO: 10722 - DNA, 1445 bp, Artificial Sequence
  Synthetic polypeptide
atgcagctgaagttgcctcagggctaccagcccggtggagggttgggagaattttgcagaaacctctttgctcctctggtaggcatttgaaaatgtggcttgggtcaggaacaggcgcccccacccgccgggtcccaggtgttcttcgattttcctttgcattgatggataggtcactcattccccctttgcaccggcacatgcctggacaccaccgtttctttcgccgtcgccccgtatgcctccggtgatacacgttcacaccatctgctgtgggatacgccagtgcctcgcatgttcccgtggtctccacctcgcattcgcccctgttcctgtttgcacgagtcctgtaaagcgcggtcggctttcctgagccccagggcttttagaagcggggtatgccactgctctttcaaaggaggagggaggcagagggttgaatgatcagtgaatttgcagccgacactttgcctcgagacctgtgggatcattctttgctgcatggaggccctgcctgccccagcagatgtggcgagcccatcctatgtcactcggtgggggcctaaatcggatctgaaggggtgtcctgagaacacagcaggcgtcctgaagctccctctccctccctccgtggaagtcagctcaaggagttcctgaggacaggattcctgggggtttggtcctgggacaggacaagacacccacggtcccgtctcccacgccgccacaaactggagcccggatccaggccgcggctgcagcgggaacctcgctgccctgcgctgcagtagcgttatttaaaggggatgcagcctgactgccagaagcggagcgctagtcaggccagccaatgcgcatgcgcgcggcgcgagcgacttctcctgtcacagtggttcccacggttgtcttagaaaccagtccctgaggcttggcaaagcaggagccctccgtggcagtgcttgtgtgtcggggctctgaggctccggcctgacctctccacagggtcgacgggaacgtctctggatgccaggagacgcaaagggccgaccagaatgaggaattcccaggcggagtccaggggaggcagcacggcatcccagcctcagggctgcccggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10723 - DNA, 790 bp, Artificial Sequence
  Synthetic polypeptide
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatga

SEQ ID NO: 10724 - DNA, 466 bp, Artificial Sequence
  Synthetic polypeptide
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaagaacccctcccacccccaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagttcgacttcacctcctgccagggcgtgctcttcgtgcttctcatga

SEQ ID NO: 10725 - DNA, 763 bp, Artificial Sequence
  Synthetic polypeptide
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctg

SEQ ID NO: 10726 - DNA, 585 bp, Artificial Sequence
  Synthetic polypeptide
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaata

SEQ ID NO: 10727 - DNA, 311 bp, Artificial Sequence
  Synthetic polypeptide
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgct

SEQ ID NO: 10728 - DNA, 1457 bp, Artificial Sequence
  Synthetic polypeptide
tgcagccgaatttgcctcagggctaccagcgcggtggagggttgggggtggggagaattttgcagaaacctctttgctcctctggtaggcatttgaaaacgtggcttgggtcaggcacaggcgcccccacccgccgggtcccaggtggtcttcgattttcctttgcattgatggataggtcactcgttccccccttgcaccggcacatgcctggacaccaccgtttctttcgctgtcgcccggtttgcctccggtgacacacgttcacaccatctgctgtgggatacgccagtgccattcgtgttcacatggtctccacctcgcaatctcccctgttcttgtttgcacgagtcctgtaaagcgcggtcggctttcctgagccccagggcttttagaagaggggtaggccactgctctttcaaaggaggagggaggcagagggttgaaggatcagtgaatttgcagcggacacttggcctcgagacctatgggatcattcttggctgcagcgaggccctgcctgcctcagcgcatgtggcgagcccatcctatctcactcagtgggggccgaaatgggatctgaaggggtgtcctgagaacacagcaggcgtcctgaagctccccctccctccctcggtggaagtcagctcaaggagttcctgaggacaggactcctgggggtttggccctgggacaggacaagacacccacggtccggtctcccaagccgccacaaactggagcccggatccagccgccgccgcggctgcagcaggaggctcgctgccgccgcgctgcggtggcgttatttaaaggggacgcagcctgaccgccaggagcggagcgccagtcgggcgggccaatgcgcatgcgcgaggcgcgagcctcttctcccgtcacagtggttcccacggttgtcttagaaaccagtccccgaggcttggcaaagcaggagcccttcgtggcagtgcttgtgtgtcggagctctgaggctccggcctgacctctcctcggggtcgacgggaacgtctccggatgccaggactcgcaaagggctgacaagaatgaggaaatcccaggcggagtccgggggaggcagcacggcatcccagcctcagggctgcccggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10729 - DNA, 2438 bp, Artificial Sequence; identical to SEQ ID NO: 9790
  Synthetic polypeptide

SEQ ID NO: 10730 - DNA, 2471 bp, Artificial Sequence; identical to SEQ ID NO: 9791
  Synthetic polypeptide

SEQ ID NO: 10731 - DNA, 396 bp, Artificial Sequence; identical to SEQ ID NO: 9008
  Synthetic polypeptide

SEQ ID NO: 10732 - DNA, 393 bp, Artificial Sequence; identical to SEQ ID NO: 9009
  Synthetic polypeptide

SEQ ID NO: 10733 - DNA, 311 bp, Artificial Sequence; identical to SEQ ID NO: 9010
  Synthetic polypeptide

SEQ ID NO: 10734 - DNA, 423 bp, Artificial Sequence; identical to SEQ ID NO: 9011
  Synthetic polypeptide

SEQ ID NO: 10735 - DNA, 1012 bp, Artificial Sequence; identical to SEQ ID NO: 9012
  Synthetic polypeptide

SEQ ID NO: 10736 - DNA, 1391 bp, Artificial Sequence; identical to SEQ ID NO: 8908
  Synthetic polypeptide

SEQ ID NO: 10737 - DNA, 206 bp, Artificial Sequence
  Synthetic polypeptide
cagctctgccacttactactggcagactctgcatataaacctctcagaacttcatcttcctcctctgtaaattagagtaattgtagaatctatttcaggattgcagtaaggatgaaatgacataataatgcaaagctctggtgaggacagtgggatgctgcctggatactgccaggcaaacgccacatccttcgatgcatgggtaa

SEQ ID NO: 10738 - DNA, 1060 bp, Artificial Sequence
  Synthetic polypeptide
gaccaccaggattcgaacctcggctctacgcattaagctgtgtggccgtggggaagccaaaaagcttctgtgagcatcggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctag

SEQ ID NO: 10739 - DNA, 1117 bp, Artificial Sequence
  Synthetic polypeptide
gaccaccaggattcgaacctcggctctacgcattaagctgtgtggccgtggggaagccaaaaagcttctgtgagcatcggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctag

SEQ ID NO: 10740 - DNA, 210 bp, Artificial Sequence
  Synthetic polypeptide
ggccagcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatga

SEQ ID NO: 10741 - DNA, 894 bp, Artificial Sequence
  Synthetic polypeptide
gagagagccctagtctgcaagccagaagatttggatgatagtcctagctctactgctactctctacgagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctga

SEQ ID NO: 10742 - DNA, 1455 bp, Artificial Sequence
  Synthetic polypeptide
tggtgcaggggaggttgtgtgagggctacctgggcggtggagctttggccttggggtgaattttgcagaaacctatttgttgctctggcaggaatttcaaattttggatccggtcagtcacaagccgcctcctgtttcccaagtgttctttaatttttcattgctgtgatggaaatgtcacttgaccctcccttccaccgggcacatgcctagacagcatcgtttgtttcgccgtcgccccacattcctctggttacacacattcaagccatctgctgtgggattggtcagtgccacacgtcaacgcatggtctccacctgggattcgcccctgttcctgtttgcacgtgtcctgtaaattgcgattggcttccagagccccagggcttttagaagcccggcaggccagtgttctttaaaaggagaagggaggcagagggctgatggatcagtgaaatttcagctgacagcatgccttgagacccatgggatcattgtgtgctgcagcgaggccctgcctgcctcaccagatgtggtgagcccatcctatctcactcggtgggggccaaaatcagatctgaaggggagtcctgagaacacagcaggcgtcctgaagctccccctccctccctcggtggaagtcggctcaaggagtttctgaggacaggactcctgggggtttggccgtgggacagaagaagacacccgcggtcccctctcccacgccgacccaaactggagcccggatccagccgccgccgcggctgcagcaggagcctccctgccgccgcgctgcggtggcgttatttaaaggggacgcagcctgaccgccaggagcggagcgccagtcgggtgggccaatgcgcatgcgcgaggcgcgagcgccttctcccgtcacagtggttcccacggttgtcttagaaaccagtccccgaggcttggcaaagcaggagcgctccgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10743 - DNA, 985 bp, Artificial Sequence; identical to SEQ ID NO: 9063
  Synthetic polypeptide

SEQ ID NO: 10744 - DNA, 207 bp, Artificial Sequence; identical to SEQ ID NO: 9064
  Synthetic polypeptide

SEQ ID NO: 10745 - DNA, 246 bp, Artificial Sequence
  Synthetic polypeptide
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtga

SEQ ID NO: 10746 - DNA, 424 bp, Artificial Sequence
  Synthetic polypeptide
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 10747 - DNA, 896 bp, Artificial Sequence
  Synthetic polypeptide
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 10748 - DNA, 617 bp, Artificial Sequence
  Synthetic polypeptide
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 10749 - DNA, 304 bp, Artificial Sequence
  Synthetic polypeptide
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaactatga

SEQ ID NO: 10750 - DNA, 304 bp, Artificial Sequence
  Synthetic polypeptide
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaactgtga

SEQ ID NO: 10751 - DNA, 357 bp, Artificial Sequence
  Synthetic polypeptide
agttgacctgtaaacaacatgggtttaaactgcatgagtcacttatgcatggattttcttctgcttctgccaccccgggaacagcaagaccaacccttcctcttcctcctctcctcagcctactcggtgtgaagacaatgaggatgaagacctttacgatgatacacttccacttaataaccagaaaaatgctggcaggtggtgcaagcaaggacatctatgcatagaattctgacagcagctggaccctcaacttcttcagaagacgagaaccctgcctggcaccgctggcaggcatctggcctgacaccgctctggaggcctcccacaagcagcaaccaagccagaaaaagttga

SEQ ID NO: 10752 - DNA, 1571 bp, Artificial Sequence
  Synthetic polypeptide
gagtcggaagtgctggattttactcctcccttaccattgtttctgagaccacaaattacttcagcctctctgagatctggaaaatggaaagagcgatttacttatctctctgagcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaatag

SEQ ID NO: 10753 - DNA, 205 bp, Artificial Sequence
  Synthetic polypeptide
gagtcggaagtgctggattttactcctcccttaccattgtttctgagaccacaaattacttcagcctctctgagatctggaaaatggaaagagcgatttacttatctctctgagcttgtctgatcccagtgaaacaatctcccagtaagaagaaaatcatcatcattttagaaaatttagaaaaatcttcactgtcggagttatt

SEQ ID NO: 10754 - DNA, 1394 bp, Artificial Sequence
  Synthetic polypeptide
actggacaaggtcatgaactcatcaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggctcgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtga

SEQ ID NO: 10755 - DNA, 237 bp, Artificial Sequence
  Synthetic polypeptide
actggacaaggtcatgaactcatcaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtg

SEQ ID NO: 10756 - DNA, 1463 bp, Artificial Sequence; identical to SEQ ID NO: 8862
  Synthetic polypeptide

SEQ ID NO: 10757 - DNA, 170 bp, Artificial Sequence; identical to SEQ ID NO: 8863
  Synthetic polypeptide

SEQ ID NO: 10758 - DNA, 239 bp, Artificial Sequence; identical to SEQ ID NO: 8864
  Synthetic polypeptide

SEQ ID NO: 10759 - DNA, 376 bp, Artificial Sequence
  Synthetic polypeptide
tgttggtagacaattctccatggatccctacatttctgcttttcttgttagcagggacactgagagcattttttctggactatattttcaaggatgttggaacagtaaatgaccttggaagatataaatagtgtctctctcaaggacagagggcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaa

SEQ ID NO: 10760 - DNA, 590 bp, Artificial Sequence
  Synthetic polypeptide
gaccagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataa

SEQ ID NO: 10761 - DNA, 614 bp, Artificial Sequence
  Synthetic polypeptide
gtgtgtgagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctag

SEQ ID NO: 10762 - DNA, 50 bp, Artificial Sequence
  Synthetic polypeptide
gtgtgtgagcctctatccggctgtggaggtcacgtctgggccgggtgatg

SEQ ID NO: 10763 - DNA, 209 bp, Artificial Sequence
  Synthetic polypeptide
gtgtgtgagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagcgcgttccttcacctcgggcagaataa

SEQ ID NO: 10764 - DNA, 617 bp, Artificial Sequence
  Synthetic polypeptide
gtgtgtgagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctag

SEQ ID NO: 10765 - DNA, 724 bp, Artificial Sequence; identical to SEQ ID NO: 8796
  Synthetic polypeptide

SEQ ID NO: 10766 - DNA, 75 bp, Artificial Sequence; identical to SEQ ID NO: 8797
  Synthetic polypeptide

SEQ ID NO: 10767 - DNA, 625 bp, Artificial Sequence
  Synthetic polypeptide
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtag

SEQ ID NO: 10768 - DNA, 466 bp, Artificial Sequence
  Synthetic polypeptide
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggctcccgggcagagaagaaagcagagcccccacctag

SEQ ID NO: 10769 - DNA, 643 bp, Artificial Sequence
  Synthetic polypeptide
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccatctgcctcaggtgtgtgcctggagggggcctggactggcatggatccagtgtgcagaagagccagcagggaaccggaagctctgatgtcaaggccagagcagttgagaatgggacccagagtagatgctga

SEQ ID NO: 10770 - DNA, 559 bp, Artificial Sequence
  Synthetic polypeptide
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagtctggaatctctggagaagccagaagcatatgtctcagaatattaa

SEQ ID NO: 10771 - DNA, 586 bp, Artificial Sequence
  Synthetic polypeptide
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccaatgaggaagtagcagtaaatccattacccttttcaagcggaggttgcaagaggttgcaagcggaggcagaataa

SEQ ID NO: 10772 - DNA, 3055 bp, Artificial Sequence; identical to SEQ ID NO: 709
  Synthetic polypeptide

SEQ ID NO: 10773 - DNA, 3058 bp, Artificial Sequence; identical to SEQ ID NO: 710
  Synthetic polypeptide

SEQ ID NO: 10774 - DNA, 2665 bp, Artificial Sequence
  Synthetic polypeptide
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 10775 - DNA, 146 bp, Artificial Sequence
  Synthetic polypeptide
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaag

SEQ ID NO: 10776 - DNA, 299 bp, Artificial Sequence
  Synthetic polypeptide
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcgg

SEQ ID NO: 10777 - DNA, 2809 bp, Artificial Sequence
  Synthetic polypeptide
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggacaggagttcagagcactttcactaccttttatgaggtagattgtgatgtcatagatgggggcagggctagtcaactttctacccacctcccaacctgtgctgagggagctccgatcgggagtggaagcagtgattcctccatgctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 10778 - DNA, 2530 bp, Artificial Sequence
  Synthetic polypeptide
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 10779 - DNA, 806 bp, Artificial Sequence; identical to SEQ ID NO: 6950
  Synthetic polypeptide

SEQ ID NO: 10780 - DNA, 200 bp, Artificial Sequence
  Synthetic polypeptide
cagtagccttggactccacttaaagtcctgcctgtcactggccatgtgaccttggagccatcactgcccctctctgaggcaaaggggaagaggcccgagctctgcacccagaggaggacccagaaggacgtcaggggaggctactgggacgctggaaggcgctgttgatccccccttccagccccatgccaggtccctag

SEQ ID NO: 10781 - DNA, 6915 bp, Artificial Sequence
  Synthetic polypeptide
ctggaaaacaatcaagatgtttatcagagcaggaagagtgaacaaattaaggcacatctcgactgtggagtactctgcagatgggtatgaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10782 - DNA, 4314 bp, Artificial Sequence
  Synthetic polypeptide
ctggaaaacaatcaagatgtttatcagagcaggaagagtgaacaaattaaggcacatctcgactgtggagtactctgcagatgggtatgaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10783 - DNA, 599 bp, Artificial Sequence
  Synthetic polypeptide
ggccgggcgcggcggctcaagcttgtaatcccagcactttgggaggccgaggcgggcggatcacctgagaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataa

SEQ ID NO: 10784 - DNA, 82 bp, Artificial Sequence
  Synthetic polypeptide
ggccgggcgcggcggctcaagcttgtaatcccagcactttgggaggccgaggcgggcggatcacctgagaaccacagaataa

SEQ ID NO: 10785 - DNA, 2450 bp, Artificial Sequence
  Synthetic polypeptide
acctccctcagaaccaacttcatcctccctcccatggcctctcaggtccactgggatctgccctggcctgggtctgacctctctccctcccggtctctgcttcaccactttgctccaggcacactggccttcttgctgttcctcaaacctgccaagctcgtccctacctcagaaccttttcgctttccgttccttctgcccggaaacctcttcctccagatcttcgcgtggctcgcgtcctcacctcattcagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaattgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaa

SEQ ID NO: 10786 - DNA, 2075 bp, Artificial Sequence; identical to SEQ ID NO: 8876
  Synthetic polypeptide

SEQ ID NO: 10787 - DNA, 1901 bp, Artificial Sequence; identical to SEQ ID NO: 8877
  Synthetic polypeptide

SEQ ID NO: 10788 - DNA, 2377 bp, Artificial Sequence
  Synthetic polypeptide
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 10789 - DNA, 793 bp, Artificial Sequence
  Synthetic polypeptide
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgtacgtaacttctgtaatgatgtattactttttttga

SEQ ID NO: 10790 - DNA, 302 bp, Artificial Sequence
  Synthetic polypeptide
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaag

SEQ ID NO: 10791 - DNA, 2344 bp, Artificial Sequence
  Synthetic polypeptide
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtaa

SEQ ID NO: 10792 - DNA, 2485 bp, Artificial Sequence
  Synthetic polypeptide
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 10793 - DNA, 2464 bp, Artificial Sequence
  Synthetic polypeptide
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataacaatattttcaatttcaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 10794 - DNA, 2464 bp, Artificial Sequence
  Synthetic polypeptide
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 10795 - DNA, 2276 bp, Artificial Sequence
  Synthetic polypeptide
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggta

SEQ ID NO: 10796 - DNA, 119 bp, Artificial Sequence; identical to SEQ ID NO: 6582
  Synthetic polypeptide

SEQ ID NO: 10797 - DNA, 395 bp, Artificial Sequence
  Synthetic polypeptide
gatttttaaactgtgtttctagcagcgcttaggcttagcaaagatgccggggataggaggagctgctgagagggaaggactggccatcggcacctcagttatggcagctctgccttggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactag

SEQ ID NO: 10798 - DNA, 906 bp, Artificial Sequence; identical to SEQ ID NO: 8754
  Synthetic polypeptide

SEQ ID NO: 10799 - DNA, 795 bp, Artificial Sequence; identical to SEQ ID NO: 8755
  Synthetic polypeptide

SEQ ID NO: 10800 - DNA, 399 bp, Artificial Sequence; identical to SEQ ID NO: 8756
  Synthetic polypeptide

SEQ ID NO: 10801 - DNA, 393 bp, Artificial Sequence; identical to SEQ ID NO: 8757
  Synthetic polypeptide

SEQ ID NO: 10802 - DNA, 1769 bp, Artificial Sequence
  Synthetic polypeptide
ggccggttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaa

SEQ ID NO: 10803 - DNA, 1790 bp, Artificial Sequence
  Synthetic polypeptide
ggccggttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacgaccaggtcatctggcttccgagatcatcagagaagataagtctgtctctttcagctgccagtaa

SEQ ID NO: 10804 - DNA, 2524 bp, Artificial Sequence
  Synthetic polypeptide
tctttatctccatttgcatcacttgctgctattgggcatgcatctgttttatgtgtgtccacccatttgactgtgagcctgcgagggcaggcatggctgatggtgcctgggtcacagtatgggcgtcgtcaatattgattggtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctga

SEQ ID NO: 10805 - DNA, 1689 bp, Artificial Sequence
  Synthetic polypeptide
tctttatctccatttgcatcacttgctgctattgggcatgcatctgttttatgtgtgtccacccatttgactgtgagcctgcgagggcaggcatggctgatggtgcctgggtcacagtatgggcgtcgtcaatattgattggtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcac

SEQ ID NO: 10806 - DNA, 673 bp, Artificial Sequence
  Synthetic polypeptide
ttctttattacaaagaactgcaaaagaggatatcgccttaccttacaaaataagatttaggtttgatttacaagcaccaccaaaaaacatttctttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataa

SEQ ID NO: 10807 - DNA, 715 bp, Artificial Sequence
  Synthetic polypeptide
ttctttattacaaagaactgcaaaagaggatatcgccttaccttacaaaataagatttaggtttgatttacaagcaccaccaaaaaacatttctttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataa

SEQ ID NO: 10808 - DNA, 1352 bp, Artificial Sequence
  Synthetic polypeptide
ttaattaattaaataaaatggacaaattcatttggaaataaaaaccaacattgacataagcagaaatttaaaaatggaattagaataatcctaacatctattaaagaaatctataattacaaactgttttacaaagaaaagtcccagcccagatgggcttggtggtgaattcttccaaatattccaatatgaaataataccatcttacataaactctttcagcaaatacaggagggagtaacattttctaacttgctttgtgaggccagtataaacctaatacaaaaatctaagctatcacaagatgtacaagcatattgcaagaaaagaaaattgaaggacaatatttcttcaatatggatacaaaaattctacacaaaatattagcatattgaatccaaattgaatagtgatatattaaaatgatgtcacatagaagccatgtgaggttattctagaaatgcaaagtttaacattcaaaatttgatgcatgtaatttttatattaaaaaaataaaaaaatccatgtggtcatctcaatagctttagaaaaagtatttgataaaattcaatatctgttcataacaaaaactctcagaaaactgggaaacaaaggacactttattaatctgataaaggacagctaaaaactcacagccaacatcatacttcatagtaaaaattttgagcacagttttcccttacttcaggagtaagacaaagaataatctgttaccacttctactcatcattatactggaggtcatagccagtgcagtaggacaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaa

SEQ ID NO: 10809 - DNA, 237 bp, Artificial Sequence
  Synthetic polypeptide
ggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtggggatagcagtgcaacagaaagctgggatgaggagctttctccttccactgtgttgtatacagcaacacagcacacacctacaagcatcacctta

SEQ ID NO: 10810 - DNA, 4080 bp, Artificial Sequence
  Synthetic polypeptide
ggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctag

SEQ ID NO: 10811 - DNA, 4119 bp, Artificial Sequence
  Synthetic polypeptide
ggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggcatttcgagagggatcccggaagtccttgcggatgaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctag

SEQ ID NO: 10812 - DNA, 595 bp, Artificial Sequence
  Synthetic polypeptide
ggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagc

SEQ ID NO: 10813 - DNA, 1166 bp, Artificial Sequence; identical to SEQ ID NO: 9148
  Synthetic polypeptide

SEQ ID NO: 10814 - DNA, 1061 bp, Artificial Sequence; identical to SEQ ID NO: 9149
  Synthetic polypeptide

SEQ ID NO: 10815 - DNA, 954 bp, Artificial Sequence
  Synthetic polypeptide
cagtgtgagcctgaggaatgagcacagatttcaggatcaggaaggccaggctggagtgctggctctgcagcgtcacaggagcttccagcccgtgtgaacctctcagctgccccagccccagtctctgctgtgcccaccggcctacactccaagatggaccagctggaggggcagctgctggcccaggtgctggcactggagaaggagcgtgtggccctcagccacagcagccgccggcagaggcaggaagtggaaaaggagttggacgtcctgcagggtcgtgtggctgagctggagcacgggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatga

SEQ ID NO: 10816 - DNA, 1168 bp, Artificial Sequence
  Synthetic polypeptide
aacctatcaatagcatcagaaagccaacaacccaatgtgatcctacatttgtgaaaaaacccacagacagtataaaggacattttagctgtgtttagagaaagaagaggaccaaagaagaattgaaatcaccacctcctgtaatcttaataggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggcttccagcgtgttgggacagtcagaggagttgtagatga

SEQ ID NO: 10817 - DNA, 1366 bp, Artificial Sequence
  Synthetic polypeptide
aacctatcaatagcatcagaaagccaacaacccaatgtgatcctacatttgtgaaaaaacccacagacagtataaaggacattttagctgtgtttagagaaagaagaggaccaaagaagaattgaaatcaccacctcctgtaatcttaataggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaaagctggtctcatcctttcccagcttggggacctcagcagttggtgcaatggactccttcaggaacccaagataagcttgcggcgcagctcactcaagtacctggggtgccgctacagcgagatcaaaccctacggacttgactgggcggagctcagccgggacctcaggaagacgtgtgaggagcagaccctgagtatcccctacaacgactatggggacagcaaagagatctag

SEQ ID NO: 10818 - DNA, 1132 bp, Artificial Sequence
  Synthetic polypeptide
aacctatcaatagcatcagaaagccaacaacccaatgtgatcctacatttgtgaaaaaacccacagacagtataaaggacattttagctgtgtttagagaaagaagaggaccaaagaagaattgaaatcaccacctcctgtaatcttaataggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggtaa

SEQ ID NO: 10819 - DNA, 559 bp, Artificial Sequence; identical to SEQ ID NO: 8901
  Synthetic polypeptide

SEQ ID NO: 10820 - DNA, 3916 bp, Artificial Sequence
  Synthetic polypeptide
tgctggtgggggtatcaactggctcaaccactctgcagaactgtctagcaggatccactaaggctcaacatctgtccaccctgtgaccctccaactcctactaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatag

SEQ ID NO: 10821 - DNA, 3697 bp, Artificial Sequence
  Synthetic polypeptide
tgctggtgggggtatcaactggctcaaccactctgcagaactgtctagcaggatccactaaggctcaacatctgtccaccctgtgaccctccaactcctactaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccagagtccgagtgccggggggaccctgtccgggactttcaccaggtccagaggggctatgccatctgccagaccacgcgccccctgtcatgggtggagtgccggggctcgtgcccaggccagggctgctgccagggccttcggctga

SEQ ID NO: 10822 - DNA, 1707 bp, Artificial Sequence
  Synthetic polypeptide
tgctggtgggggtatcaactggctcaaccactctgcagaactgtctagcaggatccactaaggctcaacatctgtccaccctgtgaccctccaactcctactaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatatgccccctctccttctgctcaccttgcagagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgt

SEQ ID NO: 10823 - DNA, 541 bp, Artificial Sequence
  Synthetic polypeptide
tgctggtgggggtatcaactggctcaaccactctgcagaactgtctagcaggatccactaaggctcaacatctgtccaccctgtgaccctccaactcctactaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctccacactggccccgtcacctgtccacacacgacaggcacacacagctcccactgcagggcctttgctgttgctgtgcctcactccaggaatgaccttgaagccatgtttgaagaggaagtacccaggattttttactcagcttga

SEQ ID NO: 10824 - DNA, 2346 bp, Artificial Sequence; identical to SEQ ID NO: 9066
  Synthetic polypeptide

SEQ ID NO: 10825 - DNA, 805 bp, Artificial Sequence
  Synthetic polypeptide
gaacataggccctgcagcccagctgcttgggggcattccactctgctggccaccagctgtgactgcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagggaagctgcgctggttgtgatctgctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttag

SEQ ID NO: 10826 - DNA, 781 bp, Artificial Sequence
  Synthetic polypeptide
gaacataggccctgcagcccagctgcttgggggcattccactctgctggccaccagctgtgactgcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttag

SEQ ID NO: 10827 - DNA, 400 bp, Artificial Sequence
  Synthetic polypeptide
gaacataggccctgcagcccagctgcttgggggcattccactctgctggccaccagctgtgactgcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagctctttagtcaagagacggtga

SEQ ID NO: 10828 - DNA, 859 bp, Artificial Sequence; identical to SEQ ID NO: 6990
  Synthetic polypeptide

SEQ ID NO: 10829 - DNA, 657 bp, Artificial Sequence; identical to SEQ ID NO: 6991
  Synthetic polypeptide

SEQ ID NO: 10830 - DNA, 587 bp, Artificial Sequence; identical to SEQ ID NO: 6992
  Synthetic polypeptide

SEQ ID NO: 10831 - DNA, 568 bp, Artificial Sequence; identical to SEQ ID NO: 6993
  Synthetic polypeptide

SEQ ID NO: 10832 - DNA, 494 bp, Artificial Sequence; identical to SEQ ID NO: 6994
  Synthetic polypeptide

SEQ ID NO: 10833 - DNA, 368 bp, Artificial Sequence; identical to SEQ ID NO: 6995
  Synthetic polypeptide

SEQ ID NO: 10834 - DNA, 393 bp, Artificial Sequence; identical to SEQ ID NO: 9054
  Synthetic polypeptide

SEQ ID NO: 10835 - DNA, 5813 bp, Artificial Sequence
  Synthetic polypeptide
gaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaa

SEQ ID NO: 10836 - DNA, 5963 bp, Artificial Sequence
  Synthetic polypeptide
gaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaa

SEQ ID NO: 10837 - DNA, 5957 bp, Artificial Sequence
  Synthetic polypeptide
gaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctgtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaa

SEQ ID NO: 10838 - DNA, 3129 bp, Artificial Sequence
  Synthetic polypeptide
gaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctc

SEQ ID NO: 10839 - DNA, 1609 bp, Artificial Sequence
  Synthetic polypeptide
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttga

SEQ ID NO: 10840 - DNA, 1681 bp, Artificial Sequence
  Synthetic polypeptide
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttga

SEQ ID NO: 10841 - DNA, 1112 bp, Artificial Sequence
  Synthetic polypeptide
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcac

SEQ ID NO: 10842 - DNA, 788 bp, Artificial Sequence
  Synthetic polypeptide
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaac

SEQ ID NO: 10843 - DNA, 703 bp, Artificial Sequence
  Synthetic polypeptide
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcagaagcataatatctcctggatatcatga

SEQ ID NO: 10844 - DNA, 793 bp, Artificial Sequence
  Synthetic polypeptide
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtacagtatcatcctgtcatctacaccatacttttcacgggtgattgcctgcaaactggagaaaaagataatggtgggttaaggatttattcgttcattcacatatatgcaccatag

SEQ ID NO: 10845 - DNA, 616 bp, Artificial Sequence
  Synthetic polypeptide
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtgagtgtttag

SEQ ID NO: 10846 - DNA, 93 bp, Artificial Sequence
  Synthetic polypeptide
tgatggctcagagcatgattctggaggcagctagctaggtcggaatttgctttgccgcatggaagctgtgccatcctgggacgcctcgtctaa

SEQ ID NO: 10847 - DNA, 1079 bp, Artificial Sequence; identical to SEQ ID NO: 6652
  Synthetic polypeptide

SEQ ID NO: 10848 - DNA, 267 bp, Artificial Sequence
  Synthetic polypeptide
aatactctcaaaacagagcctccattgccccgacaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctga

SEQ ID NO: 10849 - DNA, 264 bp, Artificial Sequence
  Synthetic polypeptide
aatactctcaaaacagagcctccattgccccgacaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctga

SEQ ID NO: 10850 - DNA, 182 bp, Artificial Sequence
  Synthetic polypeptide
aatactctcaaaacagagcctccattgccccgacaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtga

SEQ ID NO: 10851 - DNA, 294 bp, Artificial Sequence
  Synthetic polypeptide
aatactctcaaaacagagcctccattgccccgacaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaa

SEQ ID NO: 10852 - DNA, 1508 bp, Artificial Sequence
  Synthetic polypeptide
gttcctcaaaaaattaaacatagaattaccatatgatccagcaattctgcttctgagtagatacctgaagaattacaagcagctctcaaagagatatttgtacactcctgttcacagcagcactattcacagtaggcaaaaggtggaagcaagccaagcgttcactgataaatgaattgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctag

SEQ ID NO: 10853 - DNA, 6989 bp, Artificial Sequence
  Synthetic polypeptide
ggccaggcgcagtggctcatgcctgtaatcccagcactttgggaggccgaggcgggcagatcatgaagtcaagagattgagaccatcctggccaacatgattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10854 - DNA, 4388 bp, Artificial Sequence
  Synthetic polypeptide
ggccaggcgcagtggctcatgcctgtaatcccagcactttgggaggccgaggcgggcagatcatgaagtcaagagattgagaccatcctggccaacatgattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10855 - DNA, 363 bp, Artificial Sequence; identical to SEQ ID NO: 7059
  Synthetic polypeptide

SEQ ID NO: 10856 - DNA, 465 bp, Artificial Sequence; identical to SEQ ID NO: 7060
  Synthetic polypeptide

SEQ ID NO: 10857 - DNA, 2326 bp, Artificial Sequence
  Synthetic polypeptide
agtttggatatttgtcccccaaaatctcatgttgaaatttgattccctaatgttggaggtgagaccttaatgggaggtgtttgggtcatggggctggatccctcatgaatggcctggtgcttttgtcctcctagtaatgcctgctttttagtatcttgtagcaataagtaatgaagctagaagagttgtctactatagcctccctgagagttcccctgagagctacttgttgaaaagtgcataacacctttcccttctctcctgctttcctctctcaccgtatgatcgctccacacgcttgttccccttcgccttctgccaggggtggaagcagcctgaagccatcaacacaaacagatgctggtgccatgttccttgtagagcctgcagagccatgagccaaataaacttctttacaaatgacccagcttcagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaactttttcccttttcactttggttttgagggggttttgcccctggctggggtgacactgtcaaccaaagcaagggatcccaaatag

SEQ ID NO: 10858 - DNA, 1747 bp, Artificial Sequence
  Synthetic polypeptide
agtttggatatttgtcccccaaaatctcatgttgaaatttgattccctaatgttggaggtgagaccttaatgggaggtgtttgggtcatggggctggatccctcatgaatggcctggtgcttttgtcctcctagtaatgcctgctttttagtatcttgtagcaataagtaatgaagctagaagagttgtctactatagcctccctgagagttcccctgagagctacttgttgaaaagtgcataacacctttcccttctctcctgctttcctctctcaccgtatgatcgctccacacgcttgttccccttcgccttctgccaggggtggaagcagcctgaagccatcaacacaaacagatgctggtgccatgttccttgtagagcctgcagagccatgagccaaataaacttctttacaaatgacccagcttcagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggcctcccagtag

SEQ ID NO: 10859 - DNA, 2272 bp, Artificial Sequence
  Synthetic polypeptide
agtttggatatttgtcccccaaaatctcatgttgaaatttgattccctaatgttggaggtgagaccttaatgggaggtgtttgggtcatggggctggatccctcatgaatggcctggtgcttttgtcctcctagtaatgcctgctttttagtatcttgtagcaataagtaatgaagctagaagagttgtctactatagcctccctgagagttcccctgagagctacttgttgaaaagtgcataacacctttcccttctctcctgctttcctctctcaccgtatgatcgctccacacgcttgttccccttcgccttctgccaggggtggaagcagcctgaagccatcaacacaaacagatgctggtgccatgttccttgtagagcctgcagagccatgagccaaataaacttctttacaaatgacccagcttcagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctga

SEQ ID NO: 10860 - DNA, 1875 bp, Artificial Sequence; identical to SEQ ID NO: 9041
  Synthetic polypeptide

SEQ ID NO: 10861 - DNA, 2701 bp, Artificial Sequence
  Synthetic polypeptide
cagggcaatacaatggttaagagcaaggactttggagatatcatcctcattttggatcttgtgtgatctttataattgacttaacctctcaaagccttggtttttatttataaagtggcagtaatcatacactccttttacagttgtgcagattgaaggagatcaacttggaaagtgcttagcataaggcctggcatagatctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10862 - DNA, 2701 bp, Artificial Sequence
  Synthetic polypeptide
cagggcaatacaatggttaagagcaaggactttggagatatcatcctcattttggatcttgtgtgatctttataattgacttaacctctcaaagccttggtttttatttataaagtggcagtaatcatacactccttttacagttgtgcagattgaaggagatcaacttggaaagtgcttagcataaggcctggcatagatctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10863 - DNA, 6908 bp, Artificial Sequence
  Synthetic polypeptide
ctggaaaacaatcaagatgtttatcagagcaggaagagtgaacaaattaaggcacatctcgactgtggagtactctgcagatgggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10864 - DNA, 4307 bp, Artificial Sequence
  Synthetic polypeptide
ctggaaaacaatcaagatgtttatcagagcaggaagagtgaacaaattaaggcacatctcgactgtggagtactctgcagatgggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10865 - DNA, 3500 bp, Artificial Sequence
  Synthetic polypeptide
tccaccccaacaagaggccagctggagagcaagcaaacatcgagtgcagcaggagactataagggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaccggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggcgtgacctgcgagatggaggtggacgagtgcgcctcagcgccctgcctgcacgggggctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggagccgactgcggtgtggaggtggacgagtgtgcctcacggccatgcctcaacggaggccactgccaggacctgcccaatggcttccagtgtcactgcccagatggctacgcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggtgggatggctgggcaggggggtgggctgcgaatgccccctggggctatggtggggcagagaagtctgccaggtctgtggatgagtcgcttcccttccctggtcctcatgtccttatctgtgacatgaggaggacagtttaa

SEQ ID NO: 10866 - DNA, 3827 bp, Artificial Sequence
  Synthetic polypeptide
tccaccccaacaagaggccagctggagagcaagcaaacatcgagtgcagcaggagactataagggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaccggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggcgtgacctgcgagatggaggtggacgagtgcgcctcagcgccctgcctgcacgggggctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggagccgactgcggtgtggaggtggacgagtgtgcctcacggccatgcctcaacggaggccactgccaggacctgcccaatggcttccagtgtcactgcccagatggctacgcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggttgcctgtcccatccaaggagtgcagcctgaatgtcacctgcctcgatggcagcccatgtgagggtggctctcccgctgccaactgcagctgcctggagggtcttgctggccagaggtgtcaggtccccactctcccctgtgaagccaacccctgcttgaatgggggcacctgccgggcagctggaggggtgtctgaatgtatctgcaatgccagattctccggccagttctgtgaagtggcgaagggcctgcccctgccgctgccattcccactgctggaggtggccgtacctgcagcctgtgcctgcctcctcctcctcctcctgggcctcctttcagggatcctggcagcccgaaagcgccgccagtctgagggcacctacagcccaagccagcaggaggtggctggggcccggctggagatggacagtgtcctcaaggtgccaccggaggagagactcatctag

SEQ ID NO: 10867 - DNA, 977 bp, Artificial Sequence; identical to SEQ ID NO: 7082
  Synthetic polypeptide

SEQ ID NO: 10868 - DNA, 1592 bp, Artificial Sequence; identical to SEQ ID NO: 7083
  Synthetic polypeptide

SEQ ID NO: 10869 - DNA, 3052 bp, Artificial Sequence
  Synthetic polypeptide
actgaaggaaaagtaccaagagcagaatgctgcatatccagccaaaggaaagctgatgtggcaaaaatgatgctgtcaaggccgaaaaaggcaagaaaaaaaaacaaagcggagaaagacagagaagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaaacaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaa

SEQ ID NO: 10870 - DNA, 334 bp, Artificial Sequence
  Synthetic polypeptide
actgaaggaaaagtaccaagagcagaatgctgcatatccagccaaaggaaagctgatgtggcaaaaatgatgctgtcaaggccgaaaaaggcaagaaaaaaaaacaaagcggagaaagacagagaagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatag

SEQ ID NO: 10871 - DNA, 475 bp, Artificial Sequence
  Synthetic polypeptide
actgaaggaaaagtaccaagagcagaatgctgcatatccagccaaaggaaagctgatgtggcaaaaatgatgctgtcaaggccgaaaaaggcaagaaaaaaaaacaaagcggagaaagacagagaagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggtgtgtacatactggggcagcatgggcattcagcccccaccctgaagctcccaggagggcctcgtctcagagagcaaagcaaacctcccccagcttgccctctcccacatgtgcagatcaagcgtatggtgcccatgttatttcagcaacacctcctggactcagcatcatctgttgcatga

SEQ ID NO: 10872 - DNA, 500 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 10873 - DNA, 530 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacatttgcagcccacggttctctgtgtctttccaggtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 10874 - DNA, 467 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 10875 - DNA, 311 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagcacacagctgcagagacagagaggacgtgggcggcagagaggactgttgacatccaagcttcctttgtttttttttcctgtccttctctcacctcctaa

SEQ ID NO: 10876 - DNA, 695 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 10877 - DNA, 246 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtag

SEQ ID NO: 10878 - DNA, 347 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggaggaagagatagtcgctctggatcacccatggctagacgctga

SEQ ID NO: 10879 - DNA, 458 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgtag

SEQ ID NO: 10880 - DNA, 456 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgg

SEQ ID NO: 10881 - DNA, 281 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgcaggagcccgttag

SEQ ID NO: 10882 - DNA, 311 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgacagaagtggggaggctgggcacccgggtgcttctggcagctga

SEQ ID NO: 10883 - DNA, 420 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcgg

SEQ ID NO: 10884 - DNA, 344 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtctatacttcttcaccaactaggacagaagtggggaggctgggcacccgggtgcttctggcagctgatggatgctag

SEQ ID NO: 10885 - DNA, 243 bp, Artificial Sequence
  Synthetic polypeptide
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccg

SEQ ID NO: 10886 - DNA, 2641 bp, Artificial Sequence
  Synthetic polypeptide
atggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10887 - DNA, 2401 bp, Artificial Sequence
  Synthetic polypeptide
atggggattatttccaaaccagcagtcacaggaacatgctgcttttagatttgctttgtcgcaactcacagagcccccgaagctgctcccccagattgatattgtgaacatcagcgacagctttgagatgacctatagatgcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10888 - DNA, 2641 bp, Artificial Sequence
  Synthetic polypeptide
atggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10889 - DNA, 3646 bp, Artificial Sequence
  Synthetic polypeptide
tggttgagagttaagtccatggaatcagactgtcttggctgttttatttcctagctctgtgaccttgggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttcccactggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatga

SEQ ID NO: 10890 - DNA, 481 bp, Artificial Sequence
  Synthetic polypeptide
ctccaacctcccttttctactatttccatgctttctatgctttagacaaagaactcattgttttaaacattccttcctcttcttgctcctgtgattctgctcttgtgcttgcttctgcctgggaagtgcctcctccgtcctcatctcaaatctcatctctctttacacagccactgcagatgccccttccttggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 10891 - DNA, 957 bp, Artificial Sequence
  Synthetic polypeptide
atttcatccttcttttttcttagaccaacttcttagagtcattcttggcttttctttgtctctcacacctgacaatctgtaagtgagtcctgtcacatcaaaatgtattcagaatctggctagctctcaccatctacgctactaccaccctattcctagtgaccatcctctatcaccaggattattccagtagcctcctaactgatctccctgcttctcttgccctgcttctgtctattctcagcacaacaagcagtctattccaagcacaacaaccagcctattccacatcacaatttgaaatgtaaattagatcatattactccttggctcaaaacccccccccgtgacttctcatgcacttggaatcaaagctacagttattactgaaatcagcaaagtcctatatattctattcccacctcaccgtctatctaccactccttcctctgtccgtctgtcactctgttccaaacactctgggcttcttgtgagactctctgtgctccttgccagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatga

SEQ ID NO: 10892 - DNA, 810 bp, Artificial Sequence
  Synthetic polypeptide
atttcatccttcttttttcttagaccaacttcttagagtcattcttggcttttctttgtctctcacacctgacaatctgtaagtgagtcctgtcacatcaaaatgtattcagaatctggctagctctcaccatctacgctactaccaccctattcctagtgaccatcctctatcaccaggattattccagtagcctcctaactgatctccctgcttctcttgccctgcttctgtctattctcagcacaacaagcagtctattccaagcacaacaaccagcctattccacatcacaatttgaaatgtaaattagatcatattactccttggctcaaaacccccccccgtgacttctcatgcacttggaatcaaagctacagttattactgaaatcagcaaagtcctatatattctattcccacctcaccgtctatctaccactccttcctctgtccgtctgtcactctgttccaaacactctgggcttcttgtgagactctctgtgctccttgccagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggtaa

SEQ ID NO: 10893 - DNA, 806 bp, Artificial Sequence
  Synthetic polypeptide
atttcatccttcttttttcttagaccaacttcttagagtcattcttggcttttctttgtctctcacacctgacaatctgtaagtgagtcctgtcacatcaaaatgtattcagaatctggctagctctcaccatctacgctactaccaccctattcctagtgaccatcctctatcaccaggattattccagtagcctcctaactgatctccctgcttctcttgccctgcttctgtctattctcagcacaacaagcagtctattccaagcacaacaaccagcctattccacatcacaatttgaaatgtaaattagatcatattactccttggctcaaaacccccccccgtgacttctcatgcacttggaatcaaagctacagttattactgaaatcagcaaagtcctatatattctattcccacctcaccgtctatctaccactccttcctctgtccgtctgtcactctgttccaaacactctgggcttcttgtgagactctctgtgctccttgccagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatg

SEQ ID NO: 10894 - DNA, 246 bp, Artificial Sequence; identical to SEQ ID NO: 10745
  Synthetic polypeptide

SEQ ID NO: 10895 - DNA, 424 bp, Artificial Sequence; identical to SEQ ID NO: 10746
  Synthetic polypeptide

SEQ ID NO: 10896 - DNA, 173 bp, Artificial Sequence
  Synthetic polypeptide
gaacctgctaagccgattgtcaaatggatgagaaactcagagccaaggatcgggaaaacacccttaaagaacgagtgcaaacttctgctcctggaggctcccgttcactggactttgcaggagacacacaggctccccagaccccgtggtggtgcctgatgaccttcagctga

SEQ ID NO: 10897 - DNA, 159 bp, Artificial Sequence
  Synthetic polypeptide
gaacctgctaagccgattgtcaaatggatgagaaactcagagccaaggatcgggaaaacacccttaaagaacgagtgcaaacttctgctcctggaggctcccgttcactggactttgcaggagacacacaggctccccagaccccgtggtggtgcctga

SEQ ID NO: 10898 - DNA, 921 bp, Artificial Sequence; identical to SEQ ID NO: 8811
  Synthetic polypeptide

SEQ ID NO: 10899 - DNA, 861 bp, Artificial Sequence
  Synthetic polypeptide
aaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaa

SEQ ID NO: 10900 - DNA, 426 bp, Artificial Sequence
  Synthetic polypeptide
aaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacagataagctccgaagaagtatgcctaacctagcccggatgccaagtacaactgccattagtagcaacattagttctccggtc

SEQ ID NO: 10901 - DNA, 665 bp, Artificial Sequence
  Synthetic polypeptide
aaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaat

SEQ ID NO: 10902 - DNA, 385 bp, Artificial Sequence
  Synthetic polypeptide
aaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacagataagctccgaagaagtatgcctaacctagcccggatgc

SEQ ID NO: 10903 - DNA, 2086 bp, Artificial Sequence; identical to SEQ ID NO: 9039
  Synthetic polypeptide

SEQ ID NO: 10904 - DNA, 2065 bp, Artificial Sequence; identical to SEQ ID NO: 9040
  Synthetic polypeptide

SEQ ID NO: 10905 - DNA, 1457 bp, Artificial Sequence
  Synthetic polypeptide
tgcagccgaagttgcttcagggctaccagggcggtggaggtttgggggtggggcgaattttgcagaaacctctttgctcctctgctaggcatttgaaaacgtggcttgggtcaggcacaggcgcccccaccccccgggtcccaggtgttcttagattttccttggcattgatggaaaggtcactcgttccccacttccgccggcacatgcctggacaccaccatttgtttcgccgtcgccccgtatgcctccggtgacacacattcacaccatctgctgtgggatacgccagtgccacgcgtggtcacatggtctgcacctggcattcgccactgttcctgtttgcacgagccctgtaaagcgcggtcggctttccggagccccagggcttttagaagaggggtaggccactgctctttcaaaggaggagggaggcagagggttgaaggatcagtgaatttgcagctgacactaggcctcgagacctatgggatcattctttgctgcagcgaggccctgcctgcctcagcagatgtggcgagcccatcctatctcactcggtgggggccaaaatgggatctgaaggggtgtcctgagaacacagcaggcgtcctgaagctccccctccctccctcggtggaagtcagctcaaggagttcctgaggacaggactcctgggggtttggccctgggacaggacaagacacccgcggtcccctctcccacgctgccccaaactggaggccggatccagccgccgccgcgcctgcagctggagcctcgctgccgccgcgctgcggtggcgttctttaaaggggacccagcctgactgccaggagcagagttcgagtcgggccagccaatgcgcatgcgcgaggcgggagcggcttctcccgtcacagtggttcccacggttgtcttagaaagcagtcctcgaggcatggcaaagtaggagccctccatggcagtgcttgagtgtcggggctctgagtctccggcctgacctctccacgtggtcgacgggaacgtccccagatgccaggattcgcaaagggctgaccaggatggcgaaaccttaggcagagtccggggaaagcagcacggcatcccagcctcaggcctgcccggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10906 - DNA, 613 bp, Artificial Sequence
  Synthetic polypeptide
cctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatatagtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactga

SEQ ID NO: 10907 - DNA, 424 bp, Artificial Sequence
  Synthetic polypeptide
cctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatatagtagcttcgcagtgtgggggggcctgttctccaccattgactgtggcctggtgcggcttcggggcaaggaggatccctggaactctatcaccagtggagcattgaccggggctgtgctggctgcccgcagtggcccactg

SEQ ID NO: 10908 - DNA, 2165 bp, Artificial Sequence
  Synthetic polypeptide
caaagctgcagaatacacatggtgcatctttctcacaggccaggtttgctcagagacatggagacgaaaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaa

SEQ ID NO: 10909 - DNA, 1354 bp, Artificial Sequence
  Synthetic polypeptide
tgtggatcatggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctga

SEQ ID NO: 10910 - DNA, 1216 bp, Artificial Sequence
  Synthetic polypeptide
tgtggatcatggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatgagatcacctcctacaccactggattgccctgctggctgactgccccatcactgcacacatgtatgaggatgtggcactga

SEQ ID NO: 10911 - DNA, 71 bp, Artificial Sequence
  Synthetic polypeptide
tgtggatcatggaatacttcttgattcagaacgtaggaagtctgatgccagctcactcatgcctcccctga

SEQ ID NO: 10912 - DNA, 1838 bp, Artificial Sequence
  Synthetic polypeptide
atggactgaatatctgtgtccccctaaacccacatattgaaatccttcccccagtgtgatgctgtttggaagtggggcctttgggaggtgattgggtcataggggtgcagccctcatggatggatgaatgcccttctaagcccaggccagagggctagcttgctgtttctcctccaggtgaggatacaactagaagccagcagtctacaggctggaagaaggccctcaccagaacccaacccttggacttcagcctccagaactgtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagctccagggccccttttcctttgagctgacggccgagtccattggggtgaagatctcggagggtttgatgtacctgcaggaaaacagtgcgaaggtgtccgcccaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtacttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcggatgaggatgccagcggctctggagggggacagcagtatgcagatgactggatggctggggctgtggctcccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataa

SEQ ID NO: 10913 - DNA, 182 bp, Artificial Sequence
  Synthetic polypeptide
gagcatggacttggaagccggacagtcccctgttcgaatctcagcaactctacttacctgctcagtgtgtcattctttcgcgctgcacacaccttcctccacgtggtgaagatacatcgctcctgacagatccaaagggagatatcgatccatggaagatggttgctctcggaaaatgctga

SEQ ID NO: 10914 - DNA, 827 bp, Artificial Sequence
  Synthetic polypeptide
gctgggcgctgtggctcacgcctgtaatcccagcactttgggaggccgaggcaagcggattacgagcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttga

SEQ ID NO: 10915 - DNA, 605 bp, Artificial Sequence
  Synthetic polypeptide
gctgggcgctgtggctcacgcctgtaatcccagcactttgggaggccgaggcaagcggattacgagcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaatacacagcacatccagaaagaaggaagagctctcaatcaagaggcagcgtgtgagatgcttcgtgaatggcatcaagggcatatattgaaagtcacccttcccggattacacattttagctttgttacatactcattgtaaccactccgaaaagtgctgcttgatgctgcgtgctctttctgtgtccctggaggtattctga

SEQ ID NO: 10916 - DNA, 233 bp, Artificial Sequence
  Synthetic polypeptide
gctgggcgctgtggctcacgcctgtaatcccagcactttgggaggccgaggcaagcggattacgagcctacttctgcttcctcctggccgctctgggtgtgacagctggtgcccatcgcttgtggagccacaggtcctaccgggccaagctgcctctgaggatatttctggctgtcgccaactccatggctttccaggcagcagcagaagtggtcctgacccagatgccctga

SEQ ID NO: 10917 - DNA, 1335 bp, Artificial Sequence; identical to SEQ ID NO: 8839
  Synthetic polypeptide

SEQ ID NO: 10918 - DNA, 1106 bp, Artificial Sequence
  Synthetic polypeptide
ggcagcagagaatagcaaaaagagaactgagctgaggtcagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtag

SEQ ID NO: 10919 - DNA, 2219 bp, Artificial Sequence
  Synthetic polypeptide
gagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaa

SEQ ID NO: 10920 - DNA, 470 bp, Artificial Sequence
  Synthetic polypeptide
gagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggtaagtcgctgctgcctaaaagagagtggaagaaagccatactttctctgtttccagtcactttggaacaattctttactcacaggcaaacgaagcggatgctgtgacactggatgcaggtttggtgtatga

SEQ ID NO: 10921 - DNA, 485 bp, Artificial Sequence
  Synthetic polypeptide
gagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggactttctattatgctgttgctgtggtgaagaaggatag

SEQ ID NO: 10922 - DNA, 431 bp, Artificial Sequence
  Synthetic polypeptide
gagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgagggctgtgtctggctgtccctgataaaactgtgagatggtgtgcagtgtcggagcatgaggccactaagtgccagagtttccgcgaccatatgaaaagcgtcattccatccgatggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaa

SEQ ID NO: 10923 - DNA, 470 bp, Artificial Sequence; identical to SEQ ID NO: 9114
  Synthetic polypeptide

SEQ ID NO: 10924 - DNA, 134 bp, Artificial Sequence; identical to SEQ ID NO: 9115
  Synthetic polypeptide

SEQ ID NO: 10925 - DNA, 83 bp, Artificial Sequence
  Synthetic polypeptide
cgcccttctcgctctccgtttccttgcctgtggaataaggactggcattgcggactgacctccagggagaggcccagatctga

SEQ ID NO: 10926 - DNA, 555 bp, Artificial Sequence
  Synthetic polypeptide
cgcccttctcgctctccgtttccttgcctgtggaataaggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgtggagttcgggaaccagctggagggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggtaaggcatgctgggccatgtctcctcaggcctgtatccctgggccttaggagacatggcgtcccctggggggcctcacagcgcctctag

SEQ ID NO: 10927 - DNA, 1084 bp, Artificial Sequence; identical to SEQ ID NO: 580
  Synthetic polypeptide

SEQ ID NO: 10928 - DNA, 4725 bp, Artificial Sequence
  Synthetic polypeptide
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaa

SEQ ID NO: 10929 - DNA, 2215 bp, Artificial Sequence
  Synthetic polypeptide
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagca

SEQ ID NO: 10930 - DNA, 2826 bp, Artificial Sequence
  Synthetic polypeptide
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaattta

SEQ ID NO: 10931 - DNA, 2229 bp, Artificial Sequence
  Synthetic polypeptide
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatc

SEQ ID NO: 10932 - DNA, 96 bp, Artificial Sequence
  Synthetic polypeptide
tgatggctcagagcatgattctggaggcagctagctaggtcggaatttgctttgccgcatggaagctgtgccatcctggtaggacgcctcgtctaa

SEQ ID NO: 10933 - DNA, 294 bp, Artificial Sequence
  Synthetic polypeptide
agtctaatcctttccaccttcccatcctcccttatatcactcctcttctatatttccctcagctatgctgattttctcttattttcagtgccaagctactttctggtctttacatttctgttctctccctcaaaggttttctactctcatgaatccccactctgtcttgatgtacctgtgtggtctaagctggaatctggtcaccttccatccatgcaacaacttgttcaaattcttgacaatgaaatgaagctcaatgtgcatatggattcaatcccacaccatcgatcatag

SEQ ID NO: 10934 - DNA, 792 bp, Artificial Sequence; identical to SEQ ID NO: 9094
  Synthetic polypeptide

SEQ ID NO: 10935 - DNA, 699 bp, Artificial Sequence; identical to SEQ ID NO: 9095
  Synthetic polypeptide

SEQ ID NO: 10936 - DNA, 1506 bp, Artificial Sequence
  Synthetic polypeptide
tgacgtaatttgcacatctgtccttacctaaatctcatgttgaattgtaatcccctatgctggaggtttggcctggtgaaagatcacaggggtggatccatcatgaatggcttgggccatctccttggtggtaactgagctcttgctctatgttcacacatgatatggtcatttgcaagtttgtcccaccaccccctccactctttctctcttgctcctgctctgaccatgtgctgtgcctgctcccacttctccttccgccatgattgtaagcttcctgaggcctcccagaagccaagcagatgccagtcccatgcttcctgtaaaggctgcagaactgtgagccaatgaaacctcttttctttataaattacccagaatcaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaaggtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtacacagggaagtgtgtcttctcccatgtcaagaagaagtggcctttccaggaatggagctattga

SEQ ID NO: 10937 - DNA, 1182 bp, Artificial Sequence
  Synthetic polypeptide
tgacgtaatttgcacatctgtccttacctaaatctcatgttgaattgtaatcccctatgctggaggtttggcctggtgaaagatcacaggggtggatccatcatgaatggcttgggccatctccttggtggtaactgagctcttgctctatgttcacacatgatatggtcatttgcaagtttgtcccaccaccccctccactctttctctcttgctcctgctctgaccatgtgctgtgcctgctcccacttctccttccgccatgattgtaagcttcctgaggcctcccagaagccaagcagatgccagtcccatgcttcctgtaaaggctgcagaactgtgagccaatgaaacctcttttctttataaattacccagaatcaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaa

SEQ ID NO: 10938 - DNA, 1416 bp, Artificial Sequence
  Synthetic polypeptide
tgacgtaatttgcacatctgtccttacctaaatctcatgttgaattgtaatcccctatgctggaggtttggcctggtgaaagatcacaggggtggatccatcatgaatggcttgggccatctccttggtggtaactgagctcttgctctatgttcacacatgatatggtcatttgcaagtttgtcccaccaccccctccactctttctctcttgctcctgctctgaccatgtgctgtgcctgctcccacttctccttccgccatgattgtaagcttcctgaggcctcccagaagccaagcagatgccagtcccatgcttcctgtaaaggctgcagaactgtgagccaatgaaacctcttttctttataaattacccagaatcaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaa

SEQ ID NO: 10939 - DNA, 166 bp, Artificial Sequence
  Synthetic polypeptide
tggttctcaaagtgtggttcccagaacagcagcttcagcatcacctgagtttttaaaattgcatatccatccttggactcctccccagacctactgaatcagaaactctggagacgttttctttggaccaaagatctctttcgtgattccttgcaacaatcaatga

SEQ ID NO: 10940 - DNA, 213 bp, Artificial Sequence; identical to SEQ ID NO: 9051
  Synthetic polypeptide

SEQ ID NO: 10941 - DNA, 291 bp, Artificial Sequence
  Synthetic polypeptide
tgcagtggagagagcatagcacagcagtcaagtcccatggagcatttcaaacctactcttccacttcctgtcattggcccttgggatagtgttgagtttagaaacatctgcagtcatttggctctacagattgaaggacagcagtttgacagagacttgaatgctgcccaccagtgtttgaagacaatagtcaagaagctgattcagtcacttgctaattttccttcagatgcccacatggtagcctgtgcttccttgagacagatcttacagaatctcccagacatatga

SEQ ID NO: 10942 - DNA, 646 bp, Artificial Sequence; identical to SEQ ID NO: 7772
  Synthetic polypeptide

SEQ ID NO: 10943 - DNA, 304 bp, Artificial Sequence; identical to SEQ ID NO: 7773
  Synthetic polypeptide

SEQ ID NO: 10944 - DNA, 619 bp, Artificial Sequence; identical to SEQ ID NO: 7774
  Synthetic polypeptide

SEQ ID NO: 10945 - DNA, 523 bp, Artificial Sequence; identical to SEQ ID NO: 7775
  Synthetic polypeptide

SEQ ID NO: 10946 - DNA, 441 bp, Artificial Sequence; identical to SEQ ID NO: 7776
  Synthetic polypeptide

SEQ ID NO: 10947 - DNA, 167 bp, Artificial Sequence; identical to SEQ ID NO: 7777
  Synthetic polypeptide

SEQ ID NO: 10948 - DNA, 1040 bp, Artificial Sequence
  Synthetic polypeptide
ctatgcagccataaaaaatgatgagttcatgtcctttgtagggacatggatgaagctggaaaccatcattctcagcaaactatcgccaggacgaaaaaccaaacaccacatgttctcactcatagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctga

SEQ ID NO: 10949 - DNA, 371 bp, Artificial Sequence
  Synthetic polypeptide
ctatgcagccataaaaaatgatgagttcatgtcctttgtagggacatggatgaagctggaaaccatcattctcagcaaactatcgccaggacgaaaaaccaaacaccacatgttctcactcatagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgatt

SEQ ID NO: 10950 - DNA, 233 bp, Artificial Sequence
  Synthetic polypeptide
aatgtggcgccgtgagaaaagccggggacctggagtctgggagacatgagcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatag

SEQ ID NO: 10951 - DNA, 517 bp, Artificial Sequence
  Synthetic polypeptide
gcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggaaggagacggcagcctgggtcctgcccttcacctctggcggctttctctacatcgccttggtga

SEQ ID NO: 10952 - DNA, 423 bp, Artificial Sequence
  Synthetic polypeptide
gcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctgg

SEQ ID NO: 10953 - DNA, 655 bp, Artificial Sequence
  Synthetic polypeptide
gcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagttgggtgttctcccgctgcagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaa

SEQ ID NO: 10954 - DNA, 634 bp, Artificial Sequence
  Synthetic polypeptide
gcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaa

SEQ ID NO: 10955 - DNA, 355 bp, Artificial Sequence
  Synthetic polypeptide
tggagtcagatccaactgtgctgaatctggaacctactactttctagctgtgtgaactggggcagttccttaatgtctctggtcccttccataaaatgggaacaataacgcctgcttctcagctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataa

SEQ ID NO: 10956 - DNA, 3786 bp, Artificial Sequence
  Synthetic polypeptide
tatttttgaaaaaacaaaggaaaaggaagactttctcaaatttacaaaagctgaaagactatcaacagcagacctgtgtcgtaagaaatgtcaagccattgaggtcaaaggaaaaagataacaggtggaaatctggatctacataaaggaatgaagaacaatggaaataataaatataaaagacttattttaaaaattctcttccaaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttcccactggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatga

SEQ ID NO: 10957 - DNA, 1083 bp, Artificial Sequence; identical to SEQ ID NO: 7080
  Synthetic polypeptide

SEQ ID NO: 10958 - DNA, 321 bp, Artificial Sequence
  Synthetic polypeptide
ttcataagatggaataatatgcagcttttcaaagaatggatagatttatatgctgataggacaagattgccaagatgtgttactgagtgaaaaaggcaagggtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 10959 - DNA, 369 bp, Artificial Sequence
  Synthetic polypeptide
ttcataagatggaataatatgcagcttttcaaagaatggatagatttatatgctgataggacaagattgccaagatgtgttactgagtgaaaaaggcaagggtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattag

SEQ ID NO: 10960 - DNA, 294 bp, Artificial Sequence
  Synthetic polypeptide
ttcataagatggaataatatgcagcttttcaaagaatggatagatttatatgctgataggacaagattgccaagatgtgttactgagtgaaaaaggcaagggtggatccggattggtgccaatgtctccaacttcacttttgctcctagcacgattatatttcacctgggacatgctgaacagcacattagttccagaagaaagatggaaattctgaaaactgaatgtcaagaaaaggagtcaagaacaattcacagtatgagaagaaaaatggaaaaaaaaaactttatttaa

SEQ ID NO: 10961 - DNA, 6676 bp, Artificial Sequence
  Synthetic polypeptide
ccaggcatggtggctcaaactgtcatcccagcactttaggaggctgaggctggaggatcacttaagcccaggagtttgagactagtctgggcaacatagtgagatcccatttctacaaaaaataagagaaaatagctgaagacggtggcatgcacctgttgtcccaactactccagaggctgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10962 - DNA, 4075 bp, Artificial Sequence
  Synthetic polypeptide
ccaggcatggtggctcaaactgtcatcccagcactttaggaggctgaggctggaggatcacttaagcccaggagtttgagactagtctgggcaacatagtgagatcccatttctacaaaaaataagagaaaatagctgaagacggtggcatgcacctgttgtcccaactactccagaggctgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10963 - DNA, 463 bp, Artificial Sequence; identical to SEQ ID NO: 8758
  Synthetic polypeptide

SEQ ID NO: 10964 - DNA, 484 bp, Artificial Sequence
  Synthetic polypeptide
ttccccacacagcagcgagaataacctttttataactgaatcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtag

SEQ ID NO: 10965 - DNA, 471 bp, Artificial Sequence
  Synthetic polypeptide
aaaatgaatgagagccaaatgcaagagctaaagctataaacctctccgaagaaagcagaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttag

SEQ ID NO: 10966 - DNA, 952 bp, Artificial Sequence; identical to SEQ ID NO: 8583
  Synthetic polypeptide

SEQ ID NO: 10967 - DNA, 87 bp, Artificial Sequence; identical to SEQ ID NO: 8584
  Synthetic polypeptide

SEQ ID NO: 10968 - DNA, 690 bp, Artificial Sequence
  Synthetic polypeptide
ggctgggcgcggtggctcatgcctgtaatcccagcacttttggaggccaagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 10969 - DNA, 645 bp, Artificial Sequence
  Synthetic polypeptide
ggctgggcgcggtggctcatgcctgtaatcccagcacttttggaggccaagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 10970 - DNA, 406 bp, Artificial Sequence
  Synthetic polypeptide
gcatagcatcatggctgagtccaagctcttacattagcctgcctgtagctgaattttaactgccacaaattaactgcatgacctttgtcaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaa

SEQ ID NO: 10971 - DNA, 706 bp, Artificial Sequence
  Synthetic polypeptide
gcatagcatcatggctgagtccaagctcttacattagcctgcctgtagctgaattttaactgccacaaattaactgcatgacctttgtcaaggaattcagggctgggaaaatttagccgagtcatcacatttggctactacccgggaaagcagccctcccgagtcaggaacgggctccggttcatcacgtggcagccgcctgcaggagccgcaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaa

SEQ ID NO: 10972 - DNA, 862 bp, Artificial Sequence
  Synthetic polypeptide
gcatagcatcatggctgagtccaagctcttacattagcctgcctgtagctgaattttaactgccacaaattaactgcatgacctttgtcaaggaattcagggctgggaaaatttagccgagtcatcacatttggctactacccgggaaagcagccctcccgagtcaggaacgggctccggttcatcacgtggcagccgcctgcaggagccgcaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaa

SEQ ID NO: 10973 - DNA, 1511 bp, Artificial Sequence
  Synthetic polypeptide
ggggttatcatgaactcttccttctctctcagcctccagagctaatcagcaccagttttgccaccccgaaggttcaattgtccttgaaatctaacccttacccctacccccttctcttttcagcacaatcctggttcaggtttctttcattcttccacacaaggactcctaggatagcctctacctgttccccagcttctggcctctgctgtcagaatgaataatccaacacatgggcctgaccctgctcaaaatccttcagtggctcccatggctccctactgcttcagagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctga

SEQ ID NO: 10974 - DNA, 231 bp, Artificial Sequence
  Synthetic polypeptide
ttagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaa

SEQ ID NO: 10975 - DNA, 1672 bp, Artificial Sequence; identical to SEQ ID NO: 9065
  Synthetic polypeptide

SEQ ID NO: 10976 - DNA, 2799 bp, Artificial Sequence
  Synthetic polypeptide
tgaggttcaactttgatgaccatgagcaactttctctactgttttatactgcagttccctcatttataaacgggagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 10977 - DNA, 1082 bp, Artificial Sequence
  Synthetic polypeptide
aggaaatttgacggaatgggaaagagaatgggtttgggagtggctcagacctgagcctgaatccaatcttttcctgttagtaactatgagagctcggataggctttccaggctctctgaggttccatatcctttctttatagatgcagcccatccctctttctgcaaataggagtaattgaaccaaacccacagagttgtgaagattaagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattag

SEQ ID NO: 10978 - DNA, 1013 bp, Artificial Sequence
  Synthetic polypeptide
ggttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattag

SEQ ID NO: 10979 - DNA, 854 bp, Artificial Sequence
  Synthetic polypeptide
ggttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccagatatgtgccactgtttccaacttttcatcaacaaaaaggcctttccaactccttccaaattag

SEQ ID NO: 10980 - DNA, 2558 bp, Artificial Sequence
  Synthetic polypeptide
ggttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataa

SEQ ID NO: 10981 - DNA, 1149 bp, Artificial Sequence
  Synthetic polypeptide
ggagggaggctagcctgggagccagacagatggggttaggctcttgcttttgccactcgccagctctgaggcttagggcaacatgatttaattctctgatccttgtttttttcatctttctgtagactggtgatgagatgcaccctgcaggcttgcaggcttgcaggagtaattaaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccatag

SEQ ID NO: 10982 - DNA, 1050 bp, Artificial Sequence
  Synthetic polypeptide
ggggtgggcaggaaaggggaagggtgatgagacctcagtgagaggaaaggagaggaagagctggagggggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctag

SEQ ID NO: 10983 - DNA, 1107 bp, Artificial Sequence
  Synthetic polypeptide
ggggtgggcaggaaaggggaagggtgatgagacctcagtgagaggaaaggagaggaagagctggagggggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctag

SEQ ID NO: 10984 - DNA, 7042 bp, Artificial Sequence
  Synthetic polypeptide
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttag

SEQ ID NO: 10985 - DNA, 7408 bp, Artificial Sequence
  Synthetic polypeptide
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 10986 - DNA, 7147 bp, Artificial Sequence
  Synthetic polypeptide
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttag

SEQ ID NO: 10987 - DNA, 6829 bp, Artificial Sequence
  Synthetic polypeptide
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaggccccacctcctacggcatctgctagctcgtctacccctgttccattgtctccaccagatacaacttggcctcttcctgcccttgcaaccacagaaccagctaaaaacattgcacagaatcactgctgtaacatgttccaagctggtcttcataatgctctaatgaagtaa

SEQ ID NO: 10988 - DNA, 7408 bp, Artificial Sequence
  Synthetic polypeptide
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 10989 - DNA, 379 bp, Artificial Sequence; identical to SEQ ID NO: 9067
  Synthetic polypeptide

SEQ ID NO: 10990 - DNA, 948 bp, Artificial Sequence
  Synthetic polypeptide
caaggccagcctcctgacgtgcgacctgcacagtggcgcaaggcccatgctcatagttgtttggtttaaaactctgctgttgcttttttttccccccaaacattcatggagctgaatgccatcgctgtcttgaaattcttcatagttctatctttgaatttgtgctttgtaagtaacatccagtggagcactggcgcatgcgtgtgagcagaggagatacgtcccattcacacagcgttccagatgcaacatggacacagaattctggggaacctacaacgtgtgggagttcagccagactccagatgagtataaggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctggacgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctga

SEQ ID NO: 10991 - DNA, 113 bp, Artificial Sequence
  Synthetic polypeptide
ggctgggcacagtggctcatgtctgtaatcccaacactttgggaggccgaggccggtgggtcacttgaggtcaggaatttgagaccagcctggccaatatggacaagcactga

SEQ ID NO: 10992 - DNA, 447 bp, Artificial Sequence
  Synthetic polypeptide
tgtttttcttgattaattcttctgcagtacttgccatgaagtaataaacactccttccctattaaatatagcactttgaaagaaagcagactaaatcaagactgttgttcaaagtgaatagatggaagaattgatagttctgtcaggaaacaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctga

SEQ ID NO: 10993 - DNA, 811 bp, Artificial Sequence
  Synthetic polypeptide
ttcccaaagtgtgttccttggtatgccgtttcaatggaatattagcacatgttatgtgaagaaaaaaggtgctgtaactggtgagtttgggaagtgctgggttagacaaatgtaaataaggcttctttactaagaatgtctctgagcttttcatgctgtaatgtgccccgagatcttacagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaa

SEQ ID NO: 10994 - DNA, 568 bp, Artificial Sequence
  Synthetic polypeptide
ttcccaaagtgtgttccttggtatgccgtttcaatggaatattagcacatgttatgtgaagaaaaaaggtgctgtaactggtgagtttgggaagtgctgggttagacaaatgtaaataaggcttctttactaagaatgtctctgagcttttcatgctgtaatgtgccccgagatcttacagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccg

SEQ ID NO: 10995 - DNA, 716 bp, Artificial Sequence
  Synthetic polypeptide
tggaatgagccctggacaggatcctaagatccggtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcagtaa

SEQ ID NO: 10996 - DNA, 743 bp, Artificial Sequence
  Synthetic polypeptide
tggaatgagccctggacaggatcctaagatccggtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtga

SEQ ID NO: 10997 - DNA, 731 bp, Artificial Sequence
  Synthetic polypeptide
tggaatgagccctggacaggatcctaagatccggtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggttgacactctcacctga

SEQ ID NO: 10998 - DNA, 743 bp, Artificial Sequence
  Synthetic polypeptide
tggaatgagccctggacaggatcctaagatccggtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtaaagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtga

SEQ ID NO: 10999 - DNA, 1797 bp, Artificial Sequence; identical to SEQ ID NO: 7070
  Synthetic polypeptide

SEQ ID NO: 11000 - DNA, 1081 bp, Artificial Sequence; identical to SEQ ID NO: 7071
  Synthetic polypeptide

SEQ ID NO: 11001 - DNA, 1059 bp, Artificial Sequence; identical to SEQ ID NO: 7072
  Synthetic polypeptide

SEQ ID NO: 11002 - DNA, 909 bp, Artificial Sequence; identical to SEQ ID NO: 7073
  Synthetic polypeptide

SEQ ID NO: 11003 - DNA, 1435 bp, Artificial Sequence
  Synthetic polypeptide
attaggaataatattaaaaaccaaaagcagaaacaatatgttttccttttaggaaactgaggtgttctgcccttggattattagatgcagttctggctaccacaccataaaaggaaataacacagttgaagaaagcccaaggaagggtatctatgacggccaaaagaatgaagagacttttttatggtgacagacccaaactaaaccaaaaacttttcagatgaaaagggacatggcagcagcctttggtgttagggaatatggataagaccccctggagggggtgaacatcaccagccccgtgcgcctgatccatggcaccgtggggaagtcggctctgctttctgtgcagtacagcagtaccagcagcgacaggcctgtagtgaagtggcagctgaagcgggacaagccagtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatgtgcccatttcgaggccacaggtgttggtggcttcaaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcatggtggagaaccccatcagccagggccgcagcctgcctgtcaagatcaccgtatacagaagaagctccctttacatcatcttgtctacaggaggcatcttcctccttgtgaccttggtgacagtctgtgcctgctggaaaccctccaaaaggaaacagaagaagctagaaaagcaaaactccctggaatacatggatcagaatgatgaccgcctgaaaccagaagcagacaccctccctcgaagtggtgagcaggaacggaagaaccccatggcactctatatcctgaaggacaaggactccccggagaccgaggagaacccggccccggagcctcgaagcgcgacggagcccggcccgcccggctactccgtgtctcccgccgtgcccggccgctcgccggggctgcccatccgctctgcccgccgctacccgcgctccccagcgcgctccccagccaccggccggacacactcgtcgccgcccagggccccgagctcgcccggccgctcgcgcagcgcctcgcgcacactgcggactgcgggcgtgcacataatccgcgagcaagacgaggccggcccggtggagatcagcgcctga

SEQ ID NO: 11004 - DNA, 1720 bp, Artificial Sequence
  Synthetic polypeptide
ggggaggggagggccgaacgggaggtgagtgtaggggagcggagggccgaacgggagatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctatcatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtag

SEQ ID NO: 11005 - DNA, 456 bp, Artificial Sequence; identical to SEQ ID NO: 6649
  Synthetic polypeptide

SEQ ID NO: 11006 - DNA, 480 bp, Artificial Sequence; identical to SEQ ID NO: 6650
  Synthetic polypeptide

SEQ ID NO: 11007 - DNA, 186 bp, Artificial Sequence; identical to SEQ ID NO: 6651
  Synthetic polypeptide

SEQ ID NO: 11008 - DNA, 866 bp, Artificial Sequence
  Synthetic polypeptide
catgtctttgcacatgctattccctcctggaatgctcttccatgcactgtcctgcagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccgtgtctcccacaggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtgcccgccctcattgccaaaatggtgcccacgatcaatgccatcaactatgccctgggcaatgagatggtctgcaggggaatctggcagtgcctctcaccgcagaagagggagaaggaccgaaccaagtga

SEQ ID NO: 11009 - DNA, 740 bp, Artificial Sequence
  Synthetic polypeptide
catgtctttgcacatgctattccctcctggaatgctcttccatgcactgtcctgcagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtgcccgccctcattgccaaaatggtgcccacgatcaatgccatcaactatgccctgggcaatgagatggtctgcaggggaatctggcagtgcctctcaccgcagaagagggagaaggaccgaaccaagtga

SEQ ID NO: 11010 - DNA, 1541 bp, Artificial Sequence
  Synthetic polypeptide
tcagtttaaggggtcatgacgagcattttaaaaaacaaagtaggaaatatcagacagcaatgcagatagatagtaaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaa

SEQ ID NO: 11011 - DNA, 1291 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11012 - DNA, 355 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctcggacggtgcttttggtggatgcgtctag

SEQ ID NO: 11013 - DNA, 1405 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcagctccacgtcagcactgagaccagactcgagcacccctgtcctgtaagcgagacaaaatggcgtgtgttattttggggttttgtgttttttggtgggtttctttccttggctctccagatttacttttggggcctgttctaa

SEQ ID NO: 11014 - DNA, 346 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctcggacggtgcttttggtggatgcgtctag

SEQ ID NO: 11015 - DNA, 1303 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggaactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11016 - DNA, 1465 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgctggacaatatgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11017 - DNA, 1282 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11018 - DNA, 772 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11019 - DNA, 934 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11020 - DNA, 763 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11021 - DNA, 943 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11022 - DNA, 1462 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11023 - DNA, 293 bp, Artificial Sequence
  Synthetic polypeptide
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcag

SEQ ID NO: 11024 - DNA, 699 bp, Artificial Sequence
  Synthetic polypeptide
ggcccgctgagagatccattttgtttcaccctcactgtgttttttaaaaacacgaagttgccaacaattataacagaaaaatttcccatacaaatctgcgtttctggtgtcttccagaaaatctgcagatctggcctcacagctgcattccccagcaactgccctccagagggtggcatgtacatcttccagctctttgactcctatgccgccagtgggatgtgccttctcttcgtggccatctttgagtgcatctgcatcggctgggtgtatggaagcaaccggttctatgataacattgaagacatgattggctaccggccaccgtcgctcattaagtggtgctggatgatcatgacccctgggatctgcgcggggatcttcatcttcttcttgatcaagtacaagccactcaagtacaacaacatctacacctacccagcctggggctatggcattggctggctcatggccctgtcctccatgctctgcatcccgctctggatctgcatcacagtgtggaagacggaggggacactgcccgagaaactccagaagttgacgacccccagcacagatctgaaaatgcggggcaagcttggggtgagcccacggatggtgacagttaatgactgtgatgccaaactcaagagtgacgggaccatcgcagccatcacagagaaggagacgcacttctga

SEQ ID NO: 11025 - DNA, 270 bp, Artificial Sequence
  Synthetic polypeptide
gctggcagtggtgggtgcatgtctgtattcccagcaactaggaaggctgagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctag

SEQ ID NO: 11026 - DNA, 201 bp, Artificial Sequence
  Synthetic polypeptide
gctggcagtggtgggtgcatgtctgtattcccagcaactaggaaggctgagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcg

SEQ ID NO: 11027 - DNA, 216 bp, Artificial Sequence
  Synthetic polypeptide
gctggcagtggtgggtgcatgtctgtattcccagcaactaggaaggctgagggatcagagaaggctgaagaaggtggagaaactgaggcacaaaaagagggcagtgaagatgtgggcaacctccctgaagcccaggagaagaataaaatggaagctatgaagcaacatttcaaatgtctctccacaaaccaaactcaacagaatactttggcttga

SEQ ID NO: 11028 - DNA, 649 bp, Artificial Sequence
  Synthetic polypeptide
cagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaataggagctga

SEQ ID NO: 11029 - DNA, 644 bp, Artificial Sequence
  Synthetic polypeptide
cagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaatagga

SEQ ID NO: 11030 - DNA, 1136 bp, Artificial Sequence
  Synthetic polypeptide
cagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaataggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctag

SEQ ID NO: 11031 - DNA, 989 bp, Artificial Sequence
  Synthetic polypeptide
cagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaataggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctga

SEQ ID NO: 11032 - DNA, 3648 bp, Artificial Sequence
  Synthetic polypeptide
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaa

SEQ ID NO: 11033 - DNA, 1138 bp, Artificial Sequence
  Synthetic polypeptide
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagca

SEQ ID NO: 11034 - DNA, 1749 bp, Artificial Sequence
  Synthetic polypeptide
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaattta

SEQ ID NO: 11035 - DNA, 1152 bp, Artificial Sequence
  Synthetic polypeptide
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatc

SEQ ID NO: 11036 - DNA, 1771 bp, Artificial Sequence; identical to SEQ ID NO: 9104
  Synthetic polypeptide

SEQ ID NO: 11037 - DNA, 56 bp, Artificial Sequence; identical to SEQ ID NO: 9105
  Synthetic polypeptide

SEQ ID NO: 11038 - DNA, 1810 bp, Artificial Sequence; identical to SEQ ID NO: 9106
  Synthetic polypeptide

SEQ ID NO: 11039 - DNA, 1768 bp, Artificial Sequence; identical to SEQ ID NO: 9107
  Synthetic polypeptide

SEQ ID NO: 11040 - DNA, 677 bp, Artificial Sequence; identical to SEQ ID NO: 9108
  Synthetic polypeptide

SEQ ID NO: 11041 - DNA, 5350 bp, Artificial Sequence; identical to SEQ ID NO: 655
  Synthetic polypeptide

SEQ ID NO: 11042 - DNA, 665 bp, Artificial Sequence
  Synthetic polypeptide
caggcacaactgttttcatgtgtatcactttattgcacttcacaggtatcatatgtttcttacaaagtggaggtttgtggcagccctgcatggagcaagtctgtcagcaccatctttctaacagattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtga

SEQ ID NO: 11043 - DNA, 430 bp, Artificial Sequence
  Synthetic polypeptide
caggcacaactgttttcatgtgtatcactttattgcacttcacaggtatcatatgtttcttacaaagtggaggtttgtggcagccctgcatggagcaagtctgtcagcaccatctttctaacagattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaa

SEQ ID NO: 11044 - DNA, 347 bp, Artificial Sequence
  Synthetic polypeptide
caggcacaactgttttcatgtgtatcactttattgcacttcacaggtatcatatgtttcttacaaagtggaggtttgtggcagccctgcatggagcaagtctgtcagcaccatctttctaacagattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagag

SEQ ID NO: 11045 - DNA, 3082 bp, Artificial Sequence
  Synthetic polypeptide
ggccgggtgctgtggctcacgcctgtaatcccagcactttgggaggccgagaaccactcacgaattcttgtttggtgcccttgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccatccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactga

SEQ ID NO: 11046 - DNA, 415 bp, Artificial Sequence
  Synthetic polypeptide
tgatacagtttggctttgtgccctcacctaaatctcatcttgaattttaatcccctagatgtttagggagagatctggtaggaggtgattggattatgggggtggttccttcatgctgttctcatcatagtgagtgaattatcacgagatcttttggttttataaatggtagtttttcctgtgctgacacatgctcactctcgcctgctgccatgtaaaaccatgcctttgcttctcttttgccttcagccatgattgtaagtttcctgaggcctccccagccacacagaaccactgggctggcttagatgaagatgaagatgcacatgtctgggaggataattgggatgatgacaatgtagaggatgacttctctaatcagttacgggctggatacagtgaactggaggaatag

SEQ ID NO: 11047 - DNA, 406 bp, Artificial Sequence
  Synthetic polypeptide
tgatacagtttggctttgtgccctcacctaaatctcatcttgaattttaatcccctagatgtttagggagagatctggtaggaggtgattggattatgggggtggttccttcatgctgttctcatcatagtgagtgaattatcacgagatcttttggttttataaatggtagtttttcctgtgctgacacatgctcactctcgcctgctgccatgtaaaaccatgcctttgcttctcttttgccttcagccatgattgtaagtttcctgaggcctccccagccacacagaaccactgggctggcttagatgaagatgaagatgcacatgtctgggaggataattgggatgatgacaatgtagaggatgacttctctaatcagttacgctgtgagaaaaagccctga

SEQ ID NO: 11048 - DNA, 487 bp, Artificial Sequence
  Synthetic polypeptide
tgatacagtttggctttgtgccctcacctaaatctcatcttgaattttaatcccctagatgtttagggagagatctggtaggaggtgattggattatgggggtggttccttcatgctgttctcatcatagtgagtgaattatcacgagatcttttggttttataaatggtagtttttcctgtgctgacacatgctcactctcgcctgctgccatgtaaaaccatgcctttgcttctcttttgccttcagccatgattgtaagtttcctgaggcctccccagccacacagaaccactgggctggcttagatgaagatgaagatgcacatgtctgggaggataattgggatgatgacaatgtagaggatgacttctctaatcagttacgggcaactgtactcctgatgatattggtctgtgaaaccccgtatggctgctatgttctccaccaaaagggaagaatgtgcagtgctttcctctgctgttaa

SEQ ID NO: 11049 - DNA, 430 bp, Artificial Sequence
  Synthetic polypeptide
tgatacagtttggctttgtgccctcacctaaatctcatcttgaattttaatcccctagatgtttagggagagatctggtaggaggtgattggattatgggggtggttccttcatgctgttctcatcatagtgagtgaattatcacgagatcttttggttttataaatggtagtttttcctgtgctgacacatgctcactctcgcctgctgccatgtaaaaccatgcctttgcttctcttttgccttcagccatgattgtaagtttcctgaggcctccccagccacacagaaccactgggctggcttagatgaagatgaagatgcacatgtctgggaggataattgggatgatgacaatgtagaggatgacttctctaatcagttacgagctgaactagagaaacatggttataagatggagacttcatag

SEQ ID NO: 11050 - DNA, 152 bp, Artificial Sequence; identical to SEQ ID NO: 9151
  Synthetic polypeptide

SEQ ID NO: 11051 - DNA, 1765 bp, Artificial Sequence; identical to SEQ ID NO: 6684
  Synthetic polypeptide

SEQ ID NO: 11052 - DNA, 733 bp, Artificial Sequence
  Synthetic polypeptide
ggccaggcacagtggctcacgcctgtaatcccagcgttttgggaggccgaagcaggtggatcgcctcaggtcaggagtgcgagaccagcctggccaacatggtgaaaccccgtctccactaaaaatacaaaaaaattagctaggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggttacagctgaagtaaagcacaacatcaccaacactgtggtatgcagagtgcaaggggaatggaatagtgttcttgagttcacatatagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtga

SEQ ID NO: 11053 - DNA, 1443 bp, Artificial Sequence; identical to SEQ ID NO: 6760
  Synthetic polypeptide

SEQ ID NO: 11054 - DNA, 984 bp, Artificial Sequence; identical to SEQ ID NO: 6761
  Synthetic polypeptide

SEQ ID NO: 11055 - DNA, 1032 bp, Artificial Sequence; identical to SEQ ID NO: 6762
  Synthetic polypeptide

SEQ ID NO: 11056 - DNA, 1756 bp, Artificial Sequence
  Synthetic polypeptide
aacctagaattttatactcagccaaaataggaaaaacccatttgccaaaatttcaaagactcagaaagtttactacccacagacctactatgaaagaattactaaaggacgtaatccagaaagaagatatatgaaaccggaacgaatcagtccgggacacgaggccatggaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctga

SEQ ID NO: 11057 - DNA, 810 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacaacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgcc

SEQ ID NO: 11058 - DNA, 1218 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaa

SEQ ID NO: 11059 - DNA, 1137 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaa

SEQ ID NO: 11060 - DNA, 1296 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatag

SEQ ID NO: 11061 - DNA, 1173 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctga

SEQ ID NO: 11062 - DNA, 1059 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacaatttggtaaaatcttagatgttgaaattatttttaatgagcgaggctcaaaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatag

SEQ ID NO: 11063 - DNA, 1092 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacaacagatgacgcagcaccgacggatggccagccccagacacaaccttctgaaaacacggaaaacaagtctcagcccaagcggctgcatgtctccaatatccccttcaggttccgggatccggacctcagacaaatgtttggtggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatga

SEQ ID NO: 11064 - DNA, 813 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgcc

SEQ ID NO: 11065 - DNA, 1143 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatggctagtatataccgagggggatacaaccgttttgctccatactaa

SEQ ID NO: 11066 - DNA, 1221 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaa

SEQ ID NO: 11067 - DNA, 1152 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatga

SEQ ID NO: 11068 - DNA, 585 bp, Artificial Sequence
  Synthetic polypeptide
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgag

SEQ ID NO: 11069 - DNA, 256 bp, Artificial Sequence
  Synthetic polypeptide
ggctgagcgcggcagctgacgtctgtaatcccagcactttggaaggctgaggaaggtggatcacttgaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctga

SEQ ID NO: 11070 - DNA, 1114 bp, Artificial Sequence; identical to SEQ ID NO: 9614
  Synthetic polypeptide

SEQ ID NO: 11071 - DNA, 488 bp, Artificial Sequence
  Synthetic polypeptide
aggggtccccaacccctgggccacggaccagtaccagtggcctgttacgaacgaacgggctggctgcaccgcaggaggtgagcagagagcaatccagcaaagcttcatctgtatttaccgacactccccatcatttgcatctccacatcctgtcagatcagcggcagcattagattctcataggagcatgaaccctattgtgaactacatatgcaagggatctgggatctaggttgcttgctccttatgagaatctaatgcctgatgtgtcattctgtcccatcacccccagatgggaccatctagtttcatgaaaacaggctcagggctcccactgacttaatgagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaa

SEQ ID NO: 11072 - DNA, 377 bp, Artificial Sequence
  Synthetic polypeptide
aggggtccccaacccctgggccacggaccagtaccagtggcctgttacgaacgaacgggctggctgcaccgcaggaggtgagcagagagcaatccagcaaagcttcatctgtatttaccgacactccccatcatttgcatctccacatcctgtcagatcagcggcagcattagattctcataggagcatgaaccctattgtgaactacatatgcaagggatctgggatctaggttgcttgctccttatgagaatctaatgcctgatgtgtcattctgtcccatcacccccagatgggaccatctagtttcatgaaaacaggctcagggctcccactgacttaatgagaggaaccttaaccccaaagcagcctgcctt

SEQ ID NO: 11073 - DNA, 877 bp, Artificial Sequence
  Synthetic polypeptide
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaa

SEQ ID NO: 11074 - DNA, 895 bp, Artificial Sequence
  Synthetic polypeptide
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattga

SEQ ID NO: 11075 - DNA, 877 bp, Artificial Sequence
  Synthetic polypeptide
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaa

SEQ ID NO: 11076 - DNA, 943 bp, Artificial Sequence
  Synthetic polypeptide
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaa

SEQ ID NO: 11077 - DNA, 919 bp, Artificial Sequence
  Synthetic polypeptide
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaa

SEQ ID NO: 11078 - DNA, 871 bp, Artificial Sequence
  Synthetic polypeptide
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattga

SEQ ID NO: 11079 - DNA, 1392 bp, Artificial Sequence; identical to SEQ ID NO: 6782
  Synthetic polypeptide

SEQ ID NO: 11080 - DNA, 933 bp, Artificial Sequence; identical to SEQ ID NO: 6783
  Synthetic polypeptide

SEQ ID NO: 11081 - DNA, 981 bp, Artificial Sequence; identical to SEQ ID NO: 6784
  Synthetic polypeptide

SEQ ID NO: 11082 - DNA, 352 bp, Artificial Sequence
  Synthetic polypeptide
cactgtagcctgaggactcttctaaagacagcagtctgactcctgtgctcacatgccctccttggctccccattgccctctagataaagccttcaccctgcttccgccagcctcactcctcaccactgttctgaatgtcccgccgtctctctcacccctaggtctttgctcaggctgtcccctctgcctgacatcctcttctcgctcctttcctacttgtccttggcttcaccagctctttgccatccaggctgtagaagtctcctcctccaggatgccggcttgctttctcagctagggaggtgaacacaggatgactacagtgttccctgggcctcatctctgcatgtga

SEQ ID NO: 11083 - DNA, 1377 bp, Artificial Sequence
  Synthetic polypeptide
tgaattgtcattttcaatgcatgttttctggttgtataaaagctttcccatgcaatagggctgatgttataacagtagattatagtgtattttcaccagacaaagaaaactttttatgattcactgaggacaatcccttcacaatctagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtag

SEQ ID NO: 11084 - DNA, 3052 bp, Artificial Sequence; identical to SEQ ID NO: 7029
  Synthetic polypeptide

SEQ ID NO: 11085 - DNA, 3055 bp, Artificial Sequence; identical to SEQ ID NO: 7030
  Synthetic polypeptide

SEQ ID NO: 11086 - DNA, 712 bp, Artificial Sequence
  Synthetic polypeptide
cagtagtctccccttattcatagttttgttttccacagtttcagttacatgaggtcaactgcagtccgaaaatattaaacagaaaatttcagaaatgaacaatttgtaagttttaacttgcaggtggctctgagtagtgccacaaaatcttgtgtcatctggcttcatccagttcaggacatgaatcctccctttgtccagtgtctccacactgtctactgtccctggctgttagtcactgagtagccttcttcattattagattgtcatggtattgcagtgcttgtgttcaagtaacccttattatacttgatgatggctctagagtgcaagagtggtggtgcaggcattcagatatgctaaagacgagctgtcaagtgcttcctttaagcactttaggtgcttaaagatgaaagttctcaacttaaggagagaaaaaaaaatcgtatgctgaggttgctaagacctatggtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaa

SEQ ID NO: 11087 - DNA, 1018 bp, Artificial Sequence
  Synthetic polypeptide
ctacttggctgtggaatcttgagcaggcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctga

SEQ ID NO: 11088 - DNA, 1120 bp, Artificial Sequence
  Synthetic polypeptide
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11089 - DNA, 1243 bp, Artificial Sequence
  Synthetic polypeptide
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcagctccacgtcagcactgagaccagactcgagcacccctgtcctgtaagcgagacaaaatggcgtgtgttattttggggttttgtgttttttggtgggtttctttccttggctctccagatttacttttggggcctgttctaa

SEQ ID NO: 11090 - DNA, 1141 bp, Artificial Sequence
  Synthetic polypeptide
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggaactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11091 - DNA, 601 bp, Artificial Sequence
  Synthetic polypeptide
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11092 - DNA, 511 bp, Artificial Sequence
  Synthetic polypeptide
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagcgcaaagatgagctggaacagagaatgtctgctctccaggagagccggagagagctaa

SEQ ID NO: 11093 - DNA, 419 bp, Artificial Sequence
  Synthetic polypeptide
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaa

SEQ ID NO: 11094 - DNA, 1587 bp, Artificial Sequence
  Synthetic polypeptide
gcaagtcgcatcgcctctctgagcctcagtttccacatctgccatatggaggcaagattattggttccaagttccccgaagagttatctggagggcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctga

SEQ ID NO: 11095 - DNA, 166 bp, Artificial Sequence
  Synthetic polypeptide
cagctctgccacttactactggcagactctgcatataaacctctcagaacttcatcttcctcctctgtaaattagagtaattgtagaatctatttcaggattgcagtaaggatgaaatgacataataatgcaaaggcaaacgccacatccttcgatgcatgggtaa

SEQ ID NO: 11096 - DNA, 329 bp, Artificial Sequence
  Synthetic polypeptide
cagctctgccacttactactggcagactctgcatataaacctctcagaacttcatcttcctcctctgtaaattagagtaattgtagaatctatttcaggattgcagtaaggatgaaatgacataataatgcaaaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttga

SEQ ID NO: 11097 - DNA, 687 bp, Artificial Sequence
  Synthetic polypeptide
gctgtgtgtcataatggataagatgtatatttcataaccagagacagctgggaacaaatctaggccctattatttaccaactgagtgaccttgaagatgacttaacctaagaatcaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactga

SEQ ID NO: 11098 - DNA, 212 bp, Artificial Sequence
  Synthetic polypeptide
gctgtgtgtcataatggataagatgtatatttcataaccagagacagctgggaacaaatctaggccctattatttaccaactgagtgaccttgaagatgacttaacctaagaatcaggtagtgtgccagtatttgaaaaatcccaatgtatctgattcactgctgctgcagaatattttccaagctctgaatgtatattacaattattcggg

SEQ ID NO: 11099 - DNA, 1235 bp, Artificial Sequence
  Synthetic polypeptide
gatgcagcagaaacgccttgagaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtga

SEQ ID NO: 11100 - DNA, 417 bp, Artificial Sequence
  Synthetic polypeptide
ggctggtcgcagtggctcacgcctgtaatcccagcacttcgggaggccgaggcgggtggatcatgtgagggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctga

SEQ ID NO: 11101 - DNA, 220 bp, Artificial Sequence
  Synthetic polypeptide
ggctggtcgcagtggctcacgcctgtaatcccagcacttcgggaggccgaggcgggtggatcatgtgagggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctag

SEQ ID NO: 11102 - DNA, 1727 bp, Artificial Sequence
  Synthetic polypeptide
gaacacttggcttccacacgtgtctcagacagagaagcttccttagtctccttgtttcacctcatgggtgggtggattgtctagaatgagtgctaggcgatcatgactggccttgtcttctaggacagatggtgtcccattacctctgcacgtcctgtctcacaaatgagggatatcctctcctctgctcgtaggtggactgactccctgaatcttttttctgtaacgaatgtcatgaaaccaaaggaacagggctgggcctggggatggggttgcggctgggtgcaggggaggttgcgtcagggctacctgggcggtggaggcttcggggtggggtgaatgttgcagagaactccttgctcctctggcaggcatttcaaaatgtggcttggactgaggcacaggcctcctccttgttcgcaggtgttctttgattttccttggcattcagggaaaagccacttgatccgcctttccaccaggcacatgcgtggacactaatgttggtttcatcattgcaacatatgcctccggtgacatacattcacaccatctgctgtgggatacgccagtgccacgcgtgatcgcattgtctccacctcggattctcaccgaccctgtttgcacctgtcctggaaagcggtgtctgctggcaggagccccacggcttttagaagtggggcacaccactgctctttcaacggaggagggaggcagagggctcactgatcagtgaacatttagctgacaccacgccttgagggccatgggatcattctgtgcagcagcgaggccctgcctgcctcaccagatgtgctgagcccttcctttctaaccaggaggggtccaaactaagatctgaagaggattcctgagaacccagcaggcgccttgaagctccccctccatcagtggaagtcggctcaaggaggtcctgaagactggactcctgggggtttggccctgggacaggatactcaaggccccttctcccacgccgccacaaactggacccctgaaccagccgccgccgtggcagcagcaggagcctcgccgccaccacggagcagtggcgttattgaaaggggacgcagcctaactgccaggagggaagcgcgagtcggcccagccaatgcgcatgcgcgaggcgcgagcggcttctcccattacagtggttcccacggttgtcttagaaacaagtcctcgaggcttggcaaagcgggagccttccgcggcagagcttgggtgtccgggctctgaggctccggtctgacctctccacggggtcgacgggaatgtctccggatgccaggagttgcaaagggcagacctagatgaggaaaccccaggcagagtcctggggaagcagcacggcatccgagcctcaggcttgcctggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 11103 - DNA, 793 bp, Artificial Sequence
  Synthetic polypeptide
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 11104 - DNA, 703 bp, Artificial Sequence
  Synthetic polypeptide
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagagccagccgccgccacctccctactacccaccggaagataa

SEQ ID NO: 11105 - DNA, 781 bp, Artificial Sequence
  Synthetic polypeptide
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 11106 - DNA, 658 bp, Artificial Sequence
  Synthetic polypeptide
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 11107 - DNA, 574 bp, Artificial Sequence
  Synthetic polypeptide
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggcc

SEQ ID NO: 11108 - DNA, 415 bp, Artificial Sequence
  Synthetic polypeptide
ggctcagtggctcacacctgtaatcccagcactttgggaggccgagacgggaggatcacctgacgtcaggaattcaagaccagcctggtcaacatgggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctga

SEQ ID NO: 11109 - DNA, 699 bp, Artificial Sequence
  Synthetic polypeptide
caggcacaactgttttcatgtgtatcactttattgcacttcacaggtatcatatgtttcttacaaagtggaggtttgtggcagccctgcatggagcaagtctgtcagcaccatctttctaacagtatgtgctcacttcatgtctctctcacattttggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtga

SEQ ID NO: 11110 - DNA, 464 bp, Artificial Sequence
  Synthetic polypeptide
caggcacaactgttttcatgtgtatcactttattgcacttcacaggtatcatatgtttcttacaaagtggaggtttgtggcagccctgcatggagcaagtctgtcagcaccatctttctaacagtatgtgctcacttcatgtctctctcacattttggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaa

SEQ ID NO: 11111 - DNA, 381 bp, Artificial Sequence
  Synthetic polypeptide
caggcacaactgttttcatgtgtatcactttattgcacttcacaggtatcatatgtttcttacaaagtggaggtttgtggcagccctgcatggagcaagtctgtcagcaccatctttctaacagtatgtgctcacttcatgtctctctcacattttggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagag

SEQ ID NO: 11112 - DNA, 558 bp, Artificial Sequence
  Synthetic polypeptide
ggcaaggcacagtggctcacgcctgtaattccagcactttgggaggccgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaaggcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactga

SEQ ID NO: 11113 - DNA, 627 bp, Artificial Sequence
  Synthetic polypeptide
ggcaaggcacagtggctcacgcctgtaattccagcactttgggaggccgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactga

SEQ ID NO: 11114 - DNA, 942 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtga

SEQ ID NO: 11115 - DNA, 939 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttag

SEQ ID NO: 11116 - DNA, 960 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctag

SEQ ID NO: 11117 - DNA, 387 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggagtaccaggacctgctcaatgtcaagctggccctggacatcgagatcgccacctacaggaagctgctagagggcgaggagaaccggatcaccattcccgtgcagaccttctccaacctgcagatt

SEQ ID NO: 11118 - DNA, 428 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctg

SEQ ID NO: 11119 - DNA, 190 bp, Artificial Sequence
  Synthetic polypeptide
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggccc

SEQ ID NO: 11120 - DNA, 1171 bp, Artificial Sequence
  Synthetic polypeptide
gctgggcatcgtggctcacacttgtaatcccaacactttgggaggccaaggcaggcggatcacttgagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctga

SEQ ID NO: 11121 - DNA, 1257 bp, Artificial Sequence; identical to SEQ ID NO: 625
  Synthetic polypeptide

SEQ ID NO: 11122 - DNA, 1215 bp, Artificial Sequence; identical to SEQ ID NO: 626
  Synthetic polypeptide

SEQ ID NO: 11123 - DNA, 507 bp, Artificial Sequence; identical to SEQ ID NO: 628
  Synthetic polypeptide

SEQ ID NO: 11124 - DNA, 313 bp, Artificial Sequence; identical to SEQ ID NO: 629
  Synthetic polypeptide

SEQ ID NO: 11125 - DNA, 291 bp, Artificial Sequence; identical to SEQ ID NO: 630
  Synthetic polypeptide

SEQ ID NO: 11126 - DNA, 743 bp, Artificial Sequence
  Synthetic polypeptide
gcattgttcatcacactgtattacatttactcaattgcactgtttcctagaccggatgatgggcacactggagcaaggactctttaatttctatacttccggtgcctaaacaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctga

SEQ ID NO: 11127 - DNA, 752 bp, Artificial Sequence
  Synthetic polypeptide
ggccgggcgcagcggctcaagcctgtaatcccggcactttgagaggccgagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaa

SEQ ID NO: 11128 - DNA, 536 bp, Artificial Sequence
  Synthetic polypeptide
ggccgggcgcagcggctcaagcctgtaatcccggcactttgagaggccgagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgat

SEQ ID NO: 11129 - DNA, 448 bp, Artificial Sequence
  Synthetic polypeptide
gactggctgcggtgactcatgcctgtaatcccagagctttgggggatcatctgaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttga

SEQ ID NO: 11130 - DNA, 374 bp, Artificial Sequence
  Synthetic polypeptide
gactggctgcggtgactcatgcctgtaatcccagagctttgggggatcatctgaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgcccc

SEQ ID NO: 11131 - DNA, 1206 bp, Artificial Sequence; identical to SEQ ID NO: 7670
  Synthetic polypeptide

SEQ ID NO: 11132 - DNA, 1134 bp, Artificial Sequence; identical to SEQ ID NO: 7671
  Synthetic polypeptide

SEQ ID NO: 11133 - DNA, 1002 bp, Artificial Sequence; identical to SEQ ID NO: 7672
  Synthetic polypeptide

SEQ ID NO: 11134 - DNA, 590 bp, Artificial Sequence
  Synthetic polypeptide
caaaagtcagtgaactatggcccagagcgacctctgatttgtaaataaagctttattggaacatcaccacatacattcatttacatattatttatggctgcctgtgtgctacaacagcagcgctgagtcaccgtgacagagaccgtatgacctgcagagcctgagatatttactacatctgttccaccatagaaaaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttga

SEQ ID NO: 11135 - DNA, 516 bp, Artificial Sequence
  Synthetic polypeptide
caaaagtcagtgaactatggcccagagcgacctctgatttgtaaataaagctttattggaacatcaccacatacattcatttacatattatttatggctgcctgtgtgctacaacagcagcgctgagtcaccgtgacagagaccgtatgacctgcagagcctgagatatttactacatctgttccaccatagaaaaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgcccc

SEQ ID NO: 11136 - DNA, 7958 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtgtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11137 - DNA, 7265 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtgtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11138 - DNA, 304 bp, Artificial Sequence
  Synthetic polypeptide
tgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattatcactggcaagtggttttatatcgcatcggcctttcgaaacgaggagtacaataa

SEQ ID NO: 11139 - DNA, 740 bp, Artificial Sequence
  Synthetic polypeptide
tgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctag

SEQ ID NO: 11140 - DNA, 1245 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaa

SEQ ID NO: 11141 - DNA, 690 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactag

SEQ ID NO: 11142 - DNA, 1104 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaaggacagatccagaaactga

SEQ ID NO: 11143 - DNA, 711 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccac

SEQ ID NO: 11144 - DNA, 470 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtg

SEQ ID NO: 11145 - DNA, 226 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtga

SEQ ID NO: 11146 - DNA, 692 bp, Artificial Sequence
  Synthetic polypeptide
tgatatagtttggatgtgtgttcctgctcaaatctcatattgaattgtaatctccagtgttggaggtggtgcttggtgggaggtgactggatcatgcgggtggatttctcatgaatggtctagcaccatctccctaggtactgtcctcatgacagcgagtgagttctcatgagatctggttgtttaaaagtgtgtaacgcctcctccctctctcgttcctgcacctgttatgtgagatgcctccctccccctttgccttctgccatgattgtaagttttccgaggcctccccagaagccgagcagatgccagcaccatgtttcctgtacagcctgcagaactgggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaa

SEQ ID NO: 11147 - DNA, 476 bp, Artificial Sequence
  Synthetic polypeptide
tgatatagtttggatgtgtgttcctgctcaaatctcatattgaattgtaatctccagtgttggaggtggtgcttggtgggaggtgactggatcatgcgggtggatttctcatgaatggtctagcaccatctccctaggtactgtcctcatgacagcgagtgagttctcatgagatctggttgtttaaaagtgtgtaacgcctcctccctctctcgttcctgcacctgttatgtgagatgcctccctccccctttgccttctgccatgattgtaagttttccgaggcctccccagaagccgagcagatgccagcaccatgtttcctgtacagcctgcagaactgggactgtgaccctcctgggaatccagttcatggctattttgaaggaaataacttcaccttaggatccaccattagttattactgtgaagacaggtactacttagtgggcgtgcaggagcagcaatgcgttgat

SEQ ID NO: 11148 - DNA, 8217 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctgtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11149 - DNA, 7524 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctgtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11150 - DNA, 1188 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11151 - DNA, 636 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11152 - DNA, 452 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11153 - DNA, 729 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11154 - DNA, 1224 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11155 - DNA, 1143 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11156 - DNA, 906 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11157 - DNA, 822 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11158 - DNA, 885 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11159 - DNA, 153 bp, Artificial Sequence
  Synthetic polypeptide
taggcacatcctcaccctcggagcctccttctcctcacctgcaagacagaggtgacagggctcacctctcaaggctgctgagcgggctggacgctactgcttagatgcaacctccttgcaaactgtagagtgctctgagaaggtccgctgcca

SEQ ID NO: 11160 - DNA, 1608 bp, Artificial Sequence
  Synthetic polypeptide
taggcacatcctcaccctcggagcctccttctcctcacctgcaagacagaggtgacagggctcacctctcaaggctgctgagcgggctggacgctactgcttagatgcaacctccttgcaaactgtagagtgctctgagaaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaa

SEQ ID NO: 11161 - DNA, 1025 bp, Artificial Sequence; identical to SEQ ID NO: 7599
  Synthetic polypeptide

SEQ ID NO: 11162 - DNA, 871 bp, Artificial Sequence; identical to SEQ ID NO: 437
  Synthetic polypeptide

SEQ ID NO: 11163 - DNA, 421 bp, Artificial Sequence; identical to SEQ ID NO: 441
  Synthetic polypeptide

SEQ ID NO: 11164 - DNA, 638 bp, Artificial Sequence; identical to SEQ ID NO: 442
  Synthetic polypeptide

SEQ ID NO: 11165 - DNA, 337 bp, Artificial Sequence; identical to SEQ ID NO: 443
  Synthetic polypeptide

SEQ ID NO: 11166 - DNA, 261 bp, Artificial Sequence
  Synthetic polypeptide
ggccaggcgcagtggctcacacctgttatcccagcagtttggaaggctgaggcaggaggattgcttgagctcaggagttggagaccagccagggcaacacagtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaa

SEQ ID NO: 11167 - DNA, 527 bp, Artificial Sequence; identical to SEQ ID NO: 7665
  Synthetic polypeptide

SEQ ID NO: 11168 - DNA, 939 bp, Artificial Sequence
  Synthetic polypeptide
tgtagtggatccttatagatttatgttgcctcggcatccatgttgaatacaagtttaactctctcataccagcggcagggctcggtcacgctggacacagtttccagatctacaccacaccgagatggctcaagccaagtggccagagctatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtag

SEQ ID NO: 11169 - DNA, 935 bp, Artificial Sequence; identical to SEQ ID NO: 10282
  Synthetic polypeptide

SEQ ID NO: 11170 - DNA, 383 bp, Artificial Sequence; identical to SEQ ID NO: 10283
  Synthetic polypeptide

SEQ ID NO: 11171 - DNA, 199 bp, Artificial Sequence; identical to SEQ ID NO: 10284
  Synthetic polypeptide

SEQ ID NO: 11172 - DNA, 476 bp, Artificial Sequence; identical to SEQ ID NO: 10285
  Synthetic polypeptide

SEQ ID NO: 11173 - DNA, 971 bp, Artificial Sequence; identical to SEQ ID NO: 10286
  Synthetic polypeptide

SEQ ID NO: 11174 - DNA, 890 bp, Artificial Sequence; identical to SEQ ID NO: 10287
  Synthetic polypeptide

SEQ ID NO: 11175 - DNA, 653 bp, Artificial Sequence; identical to SEQ ID NO: 10288
  Synthetic polypeptide

SEQ ID NO: 11176 - DNA, 569 bp, Artificial Sequence; identical to SEQ ID NO: 10289
  Synthetic polypeptide

SEQ ID NO: 11177 - DNA, 632 bp, Artificial Sequence; identical to SEQ ID NO: 10290
  Synthetic polypeptide

SEQ ID NO: 11178 - DNA, 3609 bp, Artificial Sequence
  Synthetic polypeptide
tgatcttcagactggagctttctgggagtccagcagaaatttccagggttacgatgcaggcagtttctgtatctttagcttttagatgcattctttcctaaaatcgatttgctggagaaagtatgggtattctacctacaggttttccttcactgttgcccttttcaggaacaagacttatctctcacctagcctaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctga

SEQ ID NO: 11179 - DNA, 283 bp, Artificial Sequence
  Synthetic polypeptide
tgatcttcagactggagctttctgggagtccagcagaaatttccagggttacgatgcaggcagtttctgtatctttagcttttagatgcattctttcctaaaatcgatttgctggagaaagtatgggtattctacctacaggttttccttcactgttgcccttttcaggaacaagacttatctctcacctagcctaagttaagggaagaaagtcggaggctggctttggctgcgaaaagagaaaaaagaaaagagaagagaaggaagaaaaaggaagaacaaa

SEQ ID NO: 11180 - DNA, 523 bp, Artificial Sequence
  Synthetic polypeptide
agtatggtgatttctcaaaaaactaaacagaactaccatatgatccagcaatcccactactgggtatttatccaaaggaaaagaaatcagcatatcaaaaagatgtctacactcccatgttaattgcagcactattcacaatacgaagatatgggatcaacctaagtatccaatggatgaaaggataaataatatgtggtatatatacacaatggaatactatttggcattaaaaaagagtgaaatcatgtcatctgcagcaacatggagagaactggaggtcattatgttaactgaagtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtga

SEQ ID NO: 11181 - DNA, 1426 bp, Artificial Sequence
  Synthetic polypeptide
tgatacagaaagcgggaagggaagtgctggctagaggaggacgtggtccctggctacggctccaccgcctcggacctaggtgaggacaggcatttttgttttcctgcccaaaagttgcatttcccaagaccaccctggcctgccatgcccccatcctgtgcctataaaaaccccaaatcctaacaaggcagagacagaaccgggtggactttgagaggatcacatcggcagaggaatacacaggtggctagacatctagagaaatgcaccgaaaggcaccagtacgccagcgggccacctactggcagaagcagaatgacgctgagtttggctggggcagtcagaagacagtccaggctgctgagcagccggactctaggggaaaacgttcctactccatccccttctgacttccccccaagctacctccactcaatgaaaccctgcactcattcaccaagcccaggtgtgatccgatccttccggtaaaccaaagcaagaactcaggatacagaaagccctctgtccttgccataaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattag

SEQ ID NO: 11182 - DNA, 2751 bp, Artificial Sequence
  Synthetic polypeptide
gcatgggctctggtgtcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactga

SEQ ID NO: 11183 - DNA, 294 bp, Artificial Sequence; identical to SEQ ID NO: 6413
  Synthetic polypeptide

SEQ ID NO: 11184 - DNA, 462 bp, Artificial Sequence; identical to SEQ ID NO: 6414
  Synthetic polypeptide

SEQ ID NO: 11185 - DNA, 522 bp, Artificial Sequence; identical to SEQ ID NO: 6415
  Synthetic polypeptide

SEQ ID NO: 11186 - DNA, 414 bp, Artificial Sequence; identical to SEQ ID NO: 6416
  Synthetic polypeptide

SEQ ID NO: 11187 - DNA, 405 bp, Artificial Sequence; identical to SEQ ID NO: 6417
  Synthetic polypeptide

SEQ ID NO: 11188 - DNA, 61 bp, Artificial Sequence
  Synthetic polypeptide
tctcttaattatctcacaaagccagaccagagttggagccacccaggggaatgatctctga

SEQ ID NO: 11189 - DNA, 186 bp, Artificial Sequence; identical to SEQ ID NO: 7638
  Synthetic polypeptide

SEQ ID NO: 11190 - DNA, 1354 bp, Artificial Sequence
  Synthetic polypeptide
tgatacagaaagcgggaagggaagtgctggctagaggaggacgtggtccctggctacggctccaccgcctcggacctaggtgaggacaggcatttttgttttcctgcccaaaagttgcatttcccaagaccaccctggcctgccatgcccccatcctgtgcctataaaaaccccaaatcctaacaaggcagagacagaaccgggtggactttgagaggatcacatcggcagaggaatacacaggtggctagacatctagagaaatgcaccgaaaggcaccagtacgccagcgggccacctactggcagaagcagaatgacgctgagtttggctggggcagtcagaagacagtccaggctgctgagcagccggactctaggggaaaacgttcctactccatccccttctgacttccccccaagctacctccactcaatgaaaccctgcactcattcaccaagcccaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattag

SEQ ID NO: 11191 - DNA, 372 bp, Artificial Sequence
  Synthetic polypeptide
gagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctga

SEQ ID NO: 11192 - DNA, 270 bp, Artificial Sequence
  Synthetic polypeptide
agcgggctgtgtctggctgtccctgataaaactgtgagatggtgtgcagtgtcggagcatgaggccactaagtgccagagtttccgcgaccatatgaaaagcgtcattccatccgatggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaa

SEQ ID NO: 11193 - DNA, 2058 bp, Artificial Sequence
  Synthetic polypeptide
agcgggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaa

SEQ ID NO: 11194 - DNA, 324 bp, Artificial Sequence
  Synthetic polypeptide
agcgggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggactttctattatgctgttgctgtggtgaagaaggatag

SEQ ID NO: 11195 - DNA, 309 bp, Artificial Sequence
  Synthetic polypeptide
agcgggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggtaagtcgctgctgcctaaaagagagtggaagaaagccatactttctctgtttccagtcactttggaacaattctttactcacaggcaaacgaagcggatgctgtgacactggatgcaggtttggtgtatga

SEQ ID NO: 11196 - DNA, 80 bp, Artificial Sequence; identical to SEQ ID NO: 6364
  Synthetic polypeptide

SEQ ID NO: 11197 - DNA, 217 bp, Artificial Sequence; identical to SEQ ID NO: 6365
  Synthetic polypeptide

SEQ ID NO: 11198 - DNA, 201 bp, Artificial Sequence; identical to SEQ ID NO: 6463
  Synthetic polypeptide

SEQ ID NO: 11199 - DNA, 159 bp, Artificial Sequence; identical to SEQ ID NO: 6464
  Synthetic polypeptide

SEQ ID NO: 11200 - DNA, 953 bp, Artificial Sequence
  Synthetic polypeptide
gcttcagtctcagctccaccacttaatatcatgtgtcctggggcaatttacttcacatcccatgcctctgtttcctcatctgtaaaatggggataataatagcacttatgtcctagtgttgttattaggactaaatacggtgaaatatatggaaaccactttgaagagagctgggcacatggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttga

SEQ ID NO: 11201 - DNA, 959 bp, Artificial Sequence
  Synthetic polypeptide
gcttcagtctcagctccaccacttaatatcatgtgtcctggggcaatttacttcacatcccatgcctctgtttcctcatctgtaaaatggggataataatagcacttatgtcctagtgttgttattaggactaaatacggtgaaatatatggaaaccactttgaagagagctgggcacatggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggtaattgcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttga

SEQ ID NO: 11202 - DNA, 568 bp, Artificial Sequence
  Synthetic polypeptide
gcttcagtctcagctccaccacttaatatcatgtgtcctggggcaatttacttcacatcccatgcctctgtttcctcatctgtaaaatggggataataatagcacttatgtcctagtgttgttattaggactaaatacggtgaaatatatggaaaccactttgaagagagctgggcacatggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggtaattgcaagaagacgtcccgtcaccccctgcaccaggacctgcactatttccccttcaggcccagcgatctcatcgtttgcgcctggacggcgatggagcacatcagccggaacaacggctgtctggttgtgct

SEQ ID NO: 11203 - DNA, 330 bp, Artificial Sequence; identical to SEQ ID NO: 6490
  Synthetic polypeptide

SEQ ID NO: 11204 - DNA, 575 bp, Artificial Sequence
  Synthetic polypeptide
gctggcaagatggcggaatagaaacagctccgttctgcagctcccagtgagatcgacagagaaggcaggtgatttctgcatttccaactgaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatga

SEQ ID NO: 11205 - DNA, 782 bp, Artificial Sequence
  Synthetic polypeptide
taagtcagcagatttctgactgatgcaattaactacatacatgatgcaattaagttaggaaccaagaacaaacaactgaaaaatagaaatacgtttgaagactaaaactcacttctgaataatctatggtccaaagaagaaatcaaagggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctga

SEQ ID NO: 11206 - DNA, 2533 bp, Artificial Sequence; identical to SEQ ID NO: 6495
  Synthetic polypeptide

SEQ ID NO: 11207 - DNA, 967 bp, Artificial Sequence
  Synthetic polypeptide
tgatacagaaagcgggaagggaagtgctggctagaggaggacgtggtccctggctacggctccaccgcctcggacctaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattag

SEQ ID NO: 11208 - DNA, 336 bp, Artificial Sequence
  Synthetic polypeptide
gcacagtggctcacacagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 11209 - DNA, 174 bp, Artificial Sequence
  Synthetic polypeptide
gcacagtggctcacacagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtga

SEQ ID NO: 11210 - DNA, 279 bp, Artificial Sequence
  Synthetic polypeptide
gcacagtggctcacacagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgctcacccatgacagtctctgaatccaggccgttgggagatttcctcaccctggctcctggcgggctggcccagcgactcgggtactggttcacccggctcatgtga

SEQ ID NO: 11211 - DNA, 796 bp, Artificial Sequence
  Synthetic polypeptide
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtag

SEQ ID NO: 11212 - DNA, 502 bp, Artificial Sequence
  Synthetic polypeptide
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtgggga

SEQ ID NO: 11213 - DNA, 220 bp, Artificial Sequence
  Synthetic polypeptide
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggctttttcctggtgagtggggtctttga

SEQ ID NO: 11214 - DNA, 811 bp, Artificial Sequence
  Synthetic polypeptide
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccaggtactcccagtgcagaccctgtgtcaaggagagtggaaagcctcatttgaagagctccacgatgtggaccactttgaaattgttgagaatctgacccagaaggacaacgtgctcacccagattatcttgaaaacaatcttccagtag

SEQ ID NO: 11215 - DNA, 446 bp, Artificial Sequence
  Synthetic polypeptide
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctg

SEQ ID NO: 11216 - DNA, 581 bp, Artificial Sequence
  Synthetic polypeptide
gggggcagagccaagatggccaaataggaacagctccagtctacagctcccagtgtgagtgacgcagaagacgaatcatttctgcatttccaactgaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatga

SEQ ID NO: 11217 - DNA, 1918 bp, Artificial Sequence
  Synthetic polypeptide
ggccgggcgcagtggctcatgcctgtaatcccagcactttgggaggccaaggtggatggatcatgagctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactga

SEQ ID NO: 11218 - DNA, 727 bp, Artificial Sequence
  Synthetic polypeptide
ggccgggcgcagtggctcatgcctgtaatcccagcactttgggaggccaaggtggatggatcatgagctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacagggctccaccatccccatcaaccaggccagacccaaccgcaacctga

SEQ ID NO: 11219 - DNA, 1631 bp, Artificial Sequence; identical to SEQ ID NO: 7615
  Synthetic polypeptide

SEQ ID NO: 11220 - DNA, 1167 bp, Artificial Sequence; identical to SEQ ID NO: 6316
  Synthetic polypeptide

SEQ ID NO: 11221 - DNA, 1266 bp, Artificial Sequence; identical to SEQ ID NO: 6317
  Synthetic polypeptide

SEQ ID NO: 11222 - DNA, 274 bp, Artificial Sequence; identical to SEQ ID NO: 7601
  Synthetic polypeptide

SEQ ID NO: 11223 - DNA, 418 bp, Artificial Sequence
  Synthetic polypeptide
ctgggcaccacagtgagggttatgggataatccagctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11224 - DNA, 386 bp, Artificial Sequence
  Synthetic polypeptide
cagctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11225 - DNA, 457 bp, Artificial Sequence
  Synthetic polypeptide
ctgggcaccacagtgagggttatgggataatccagctgcctgggcaccatagtgaaggtaatgggataatccagctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11226 - DNA, 496 bp, Artificial Sequence
  Synthetic polypeptide
ctgggcaccacagtgagggttatgggataatccagctgcctgggcaccatagtgaaggtaatgggataatccagctgcctgggcaccatagtgaaggtaatgggataatccagctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11227 - DNA, 418 bp, Artificial Sequence; identical to SEQ ID NO: 11223
  Synthetic polypeptide

SEQ ID NO: 11228 - DNA, 418 bp, Artificial Sequence; identical to SEQ ID NO: 11223
  Synthetic polypeptide

SEQ ID NO: 11229 - DNA, 385 bp, Artificial Sequence
  Synthetic polypeptide
agctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11230 - DNA, 385 bp, Artificial Sequence; identical to SEQ ID NO: 11229
  Synthetic polypeptide

SEQ ID NO: 11231 - DNA, 385 bp, Artificial Sequence; identical to SEQ ID NO: 11229
  Synthetic polypeptide

SEQ ID NO: 11232 - DNA, 418 bp, Artificial Sequence; identical to SEQ ID NO: 11223
  Synthetic polypeptide

SEQ ID NO: 11233 - DNA, 418 bp, Artificial Sequence; identical to SEQ ID NO: 11223
  Synthetic polypeptide

SEQ ID NO: 11234 - DNA, 418 bp, Artificial Sequence; identical to SEQ ID NO: 11223
  Synthetic polypeptide

SEQ ID NO: 11235 - DNA, 1146 bp, Artificial Sequence
  Synthetic polypeptide
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11236 - DNA, 1074 bp, Artificial Sequence
  Synthetic polypeptide
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11237 - DNA, 942 bp, Artificial Sequence
  Synthetic polypeptide
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 11238 - DNA, 7991 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgatgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11239 - DNA, 7298 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgatgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11240 - DNA, 1639 bp, Artificial Sequence
  Synthetic polypeptide
ccacagaatggaagctccatgagggcagggctgtgactgtcctattggttgatgtgtactgagcacccgacagtgcctgtcatatggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtag

SEQ ID NO: 11241 - DNA, 1522 bp, Artificial Sequence
  Synthetic polypeptide
ccacagaatggaagctccatgagggcagggctgtgactgtcctattggttgatgtgtactgagcacccgacagtgcctgtcatatggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtag

SEQ ID NO: 11242 - DNA, 773 bp, Artificial Sequence
  Synthetic polypeptide
ccacagaatggaagctccatgagggcagggctgtgactgtcctattggttgatgtgtactgagcacccgacagtgcctgtcatatggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcag

SEQ ID NO: 11243 - DNA, 1570 bp, Artificial Sequence
  Synthetic polypeptide
tacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11244 - DNA, 1498 bp, Artificial Sequence
  Synthetic polypeptide
tacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11245 - DNA, 1366 bp, Artificial Sequence
  Synthetic polypeptide
tacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 11246 - DNA, 1044 bp, Artificial Sequence
  Synthetic polypeptide
taatatggtttggctgtgtccccacttaaatctcatcttgaattcccacatgctgtgggagggacccagtgggaggtaattgaatcatgggggcaggtgtttcctgtgctgttctcgtgatagtgaataagtctcatgagatctggtggttttaaaaaggggaatttccctgcacaagctgtcttctcttgtctgccaccatgtgagatgtgcctttcatcttctgccatgattgtgaggcctccccacccacgcggaactgacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttag

SEQ ID NO: 11247 - DNA, 957 bp, Artificial Sequence
  Synthetic polypeptide
taatatggtttggctgtgtccccacttaaatctcatcttgaattcccacatgctgtgggagggacccagtgggaggtaattgaatcatgggggcaggtgtttcctgtgctgttctcgtgatagtgaataagtctcatgagatctggtggttttaaaaaggggaatttccctgcacaagctgtcttctcttgtctgccaccatgtgagatgtgcctttcatcttctgccatgattgtgaggcctccccacccacgcggaactgacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacaggaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttag

SEQ ID NO: 11248 - DNA, 268 bp, Artificial Sequence
  Synthetic polypeptide
taatatggtttggctgtgtccccacttaaatctcatcttgaattcccacatgctgtgggagggacccagtgggaggtaattgaatcatgggggcaggtgtttcctgtgctgttctcgtgatagtgaataagtctcatgagatctggtggttttaaaaaggggaatttccctgcacaagctgtcttctcttgtctgccaccatgtgagatgtgcctttcatcttctgccatgattgtgaggcctccccacccacgcggaactgacctga

SEQ ID NO: 11249 - DNA, 1635 bp, Artificial Sequence
  Synthetic polypeptide
gatctacttctggccaccagagctgtgagagaataaatttcagttgttttaagccacccaatttgaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactga

SEQ ID NO: 11250 - DNA, 1704 bp, Artificial Sequence
  Synthetic polypeptide
gatctacttctggccaccagagctgtgagagaataaatttcagttgttttaagccacccaatttgaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactgaaactgagaagaaaatatggcacttcaaatatcctatcttcttcctgtgtatagggctagacttacagattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactga

SEQ ID NO: 11251 - DNA, 852 bp, Artificial Sequence; identical to SEQ ID NO: 753
  Synthetic polypeptide

SEQ ID NO: 11252 - DNA, 772 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11253 - DNA, 955 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11254 - DNA, 928 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11255 - DNA, 889 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11256 - DNA, 916 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11257 - DNA, 904 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11258 - DNA, 901 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11259 - DNA, 940 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11260 - DNA, 793 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctggtgagcacctcccaaagcccagagccttttgctgcaccacctctgcccaaatactcagctccttgagtccatccacccaggccttctag

SEQ ID NO: 11261 - DNA, 943 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11262 - DNA, 811 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11263 - DNA, 826 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11264 - DNA, 862 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtacggtgggacactgagggcttggaggccacaccagggcaggaaggggttggtgaaacattga

SEQ ID NO: 11265 - DNA, 598 bp, Artificial Sequence
  Synthetic polypeptide
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtggtgagatggtgctagagcaatag

SEQ ID NO: 11266 - DNA, 215 bp, Artificial Sequence
  Synthetic polypeptide
cttaatcagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcatag

SEQ ID NO: 11267 - DNA, 329 bp, Artificial Sequence
  Synthetic polypeptide
cttaatcagggatcaagtttgtggttctagcagatcctaggcaagctggaatagattctcttctccgaaagatttatgagatttactcagactttgccctcaagaatccattctattccttagaaatgcctatcagagcgtgcagggggaaggccaccgtgggatggtgctccggaacctggactctcttcactcagccttcttggacactcggcccatcttggtgcggatgtttcgtaggaggaagaaggcagccgtgctggccgcacaaatcacttcagccacccagaaggctgtgctccaactgtagtgcttggcaatggtgctga

SEQ ID NO: 11268 - DNA, 40 bp, Artificial Sequence
  Synthetic polypeptide
cttaatcagggatcaagtttgtggttctagcagatcctag

SEQ ID NO: 11269 - DNA, 369 bp, Artificial Sequence; identical to SEQ ID NO: 6492
  Synthetic polypeptide

SEQ ID NO: 11270 - DNA, 1542 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaa

SEQ ID NO: 11271 - DNA, 987 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactag

SEQ ID NO: 11272 - DNA, 273 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagatgacaaggagtatgtgggctttgcaaccctccccaaccaagtccaccgaaagtccgtga

SEQ ID NO: 11273 - DNA, 767 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtg

SEQ ID NO: 11274 - DNA, 379 bp, Artificial Sequence
  Synthetic polypeptide
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagt

SEQ ID NO: 11275 - DNA, 361 bp, Artificial Sequence
  Synthetic polypeptide
acagaaaaccagaggccccgatgtaatcctgggtctgccttcatctttctgtgtggccttaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctga

SEQ ID NO: 11276 - DNA, 444 bp, Artificial Sequence
  Synthetic polypeptide
tcccggttcaaaaccaccacttgctggttgaggagtcgtcagtaagtggctgcgcccccaccctgaggcttgtttctccatctgtacaatggaaatgatgaagatgcccacctgatagggtttttgtggcaaataacatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaa

SEQ ID NO: 11277 - DNA, 597 bp, Artificial Sequence
  Synthetic polypeptide
tcccggttcaaaaccaccacttgctggttgaggagtcgtcagtaagtggctgcgcccccaccctgaggcttgtttctccatctgtacaatggaaatgatgaagatgcccacctgatagggtttttgtggcaaataacatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaa

SEQ ID NO: 11278 - DNA, 282 bp, Artificial Sequence
  Synthetic polypeptide
tcccggttcaaaaccaccacttgctggttgaggagtcgtcagtaagtggctgcgcccccaccctgaggcttgtttctccatctgtacaatggaaatgatgaagatgcccacctgatagggtttttgtggcaaataacatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtga

SEQ ID NO: 11279 - DNA, 784 bp, Artificial Sequence; identical to SEQ ID NO: 6798
  Synthetic polypeptide

SEQ ID NO: 11280 - DNA, 1530 bp, Artificial Sequence
  Synthetic polypeptide
gctgggcacgatggttctcacctgcaatcccagcactttaggaggccaagacaggaggatcgcttgaggccaggaattcaaggcaacacggtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctga

SEQ ID NO: 11281 - DNA, 378 bp, Artificial Sequence
  Synthetic polypeptide
gctgggcacgatggttctcacctgcaatcccagcactttaggaggccaagacaggaggatcgcttgaggccaggaattcaaggcaacacggtgcacctgggaactggagacccctacacacctggcttcccttccttcaatcaaacccagttccctccagttgcatcatcaggccttcccagcatcccagcccagcccatcagtgcagacattgcctcccgcctgctgaggctggagtgcagtggtgcaatcttggctcactgcaacctccacctcccgggttcaagtgattcttctgcctcagactccagagtatctaggattacaggaagctcaaaggccctgtggccccccaagaatggcaggggagcctcctag

SEQ ID NO: 11282 - DNA, 1327 bp, Artificial Sequence; identical to SEQ ID NO: 6801
  Synthetic polypeptide

SEQ ID NO: 11283 - DNA, 183 bp, Artificial Sequence
  Synthetic polypeptide
ccgctcccttcctgtgtgcgcctggcaaggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctga

SEQ ID NO: 11284 - DNA, 535 bp, Artificial Sequence; identical to SEQ ID NO: 10018
  Synthetic polypeptide

SEQ ID NO: 11285 - DNA, 686 bp, Artificial Sequence
  Synthetic polypeptide
tgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctag

SEQ ID NO: 11286 - DNA, 1206 bp, Artificial Sequence
  Synthetic polypeptide
gagctgtaagttccacaaggatggggaccacatctgcccttatgtttgcccagcacctagcccaatgcttggctcaaattagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtga

SEQ ID NO: 11287 - DNA, 494 bp, Artificial Sequence; identical to SEQ ID NO: 10040
  Synthetic polypeptide

SEQ ID NO: 11288 - DNA, 804 bp, Artificial Sequence; identical to SEQ ID NO: 10041
  Synthetic polypeptide

SEQ ID NO: 11289 - DNA, 1911 bp, Artificial Sequence; identical to SEQ ID NO: 10042
  Synthetic polypeptide

SEQ ID NO: 11290 - DNA, 531 bp, Artificial Sequence; identical to SEQ ID NO: 10043
  Synthetic polypeptide

SEQ ID NO: 11291 - DNA, 1288 bp, Artificial Sequence
  Synthetic polypeptide
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11292 - DNA, 1216 bp, Artificial Sequence
  Synthetic polypeptide
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11293 - DNA, 1084 bp, Artificial Sequence
  Synthetic polypeptide
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 11294 - DNA, 1819 bp, Artificial Sequence
  Synthetic polypeptide
tgatatggttcagttgtgtctccacccaaatcccatcttgaattgtaatccccataatccccacgtgtcatgggagggacctggtgggaggtgattggatcatgggagcagtttcccccatgctgctctcgtgatagtgagtgagttctcacgagatctgatggttttataagcgtctgtcatttcccctgctaatgctcattctcctgccaccctgtgaagaggagccttccaccatgattgtaagtttcctgaggcctctccagccatgaggaactctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaagaaaagattcatttaaaaccagtcacacttctaactgaacaagatcatgtggaacataatctggctgctgagagaaggaaagttcgattacaacatgaagatacctttaacaatttaatgaaggaaagtagcaaatttgatgatctcatttttgatgaagaggaaggagcggtttccacaaggggcacctccgttcagagcattgaactggtcctcccaccccatgcaaaccatcacggaaatacatttggtggccagattatggcgtggatggagacagtggctactatttctgcaagccgcctgtgttgggctcatccctttctgaagtccgtagatatgtttaagttccggggaccatctacagttggagatcgtcttgtcttcactgccattgtcaacaatacatttcagacctgtgttgaagttggagttcgcgtggaggcctttgactgtcaggaatgggccgagggccgagggcgtcacatcaacagtgcttttctcatttacaatgctgctgatgataaggaaaatctcatcacgtttcccagaatccaacccatttcaaaggatgatttcagacgctatcggggagctattgcacgcaagcgaattcgcctaggcagaaaatatgttatttcccacaaagaagaggttccactttgcatacactgggatatcagcaagcaggcatccctgagtgacagcaatgtggaggccctcaaaaaactggcagccaaaaggggttgggaggttaccagcactgtggaaaagataaaaatatatactctggaagagcatgatgttttatctgtttgggttgaaaagcacgtgggaagtccagcacatttggcttatcgtctcttgtctgactttacaaagcgacctttgtgggacccccattttgtgtcctgtgaagtcatagactgggtgagtgaagatgatcagctgtatcacatcacctgtcctatactgaatgatgacaaacccaaagacttggtagtactcgtatcacgaagaaaacccctcaaagatggtaacacttacacagtggcagtgaagtcggtcattttgccatcggtccccccgtctccacagtacatcagaagtgaaatcatatgtgccggatttctcatccatgctattgacagcaattcatgcatcgtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaa

SEQ ID NO: 11295 - DNA, 655 bp, Artificial Sequence
  Synthetic polypeptide
tgatatggttcagttgtgtctccacccaaatcccatcttgaattgtaatccccataatccccacgtgtcatgggagggacctggtgggaggtgattggatcatgggagcagtttcccccatgctgctctcgtgatagtgagtgagttctcacgagatctgatggttttataagcgtctgtcatttcccctgctaatgctcattctcctgccaccctgtgaagaggagccttccaccatgattgtaagtttcctgaggcctctccagccatgaggaactctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaagaaaagattcatttaaaaccagtcacacttctaactgaacaagatcatgtggaacataatctggctgctgagagaaggaaagttcgattacaacatgaagatacctttaacaatttaatgaaggaaagtagcaaatttgatggtcagtaa

SEQ ID NO: 11296 - DNA, 1232 bp, Artificial Sequence; identical to SEQ ID NO: 6566
  Synthetic polypeptide

SEQ ID NO: 11297 - DNA, 497 bp, Artificial Sequence; identical to SEQ ID NO: 6567
  Synthetic polypeptide

SEQ ID NO: 11298 - DNA, 575 bp, Artificial Sequence; identical to SEQ ID NO: 6568
  Synthetic polypeptide

SEQ ID NO: 11299 - DNA, 928 bp, Artificial Sequence
  Synthetic polypeptide
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggag

SEQ ID NO: 11300 - DNA, 1942 bp, Artificial Sequence
  Synthetic polypeptide
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcagccccagcttggtgaccgggtggctccattcaccctgggtccctcgctgaaacggtgcctgggaccagagcagagaacacgcttgccagtggtaggagatggaggcgacgtggactctgggaggcttcttttttggggtccatccagaggccgagcctctccaagcactggtcagcctccatgccacccagtctgccgaccctcctctccaccatcccctcgtccgagcagtggcgatccctcccgagtcaaggctgggcacaagcacgtggggacaggccgggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtga

SEQ ID NO: 11301 - DNA, 1660 bp, Artificial Sequence
  Synthetic polypeptide
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtga

SEQ ID NO: 11302 - DNA, 175 bp, Artificial Sequence
  Synthetic polypeptide
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaaatgcccctgggctgtctga

SEQ ID NO: 11303 - DNA, 547 bp, Artificial Sequence
  Synthetic polypeptide
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtaggcggcctgctcttgctcacccagtccccgctcactttcagcccactttccaactggaaaatctgctgtcccgcagccgtctccagggcagtggcgggagactcgggctcttga

SEQ ID NO: 11304 - DNA, 481 bp, Artificial Sequence
  Synthetic polypeptide
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagcccgtggaccgggagcccgtggaccgggagccggtggtgtgccaccccgacctggaggagcggctgcaggcctggccagcggagctgcctgatgagttctttgagctga

SEQ ID NO: 11305 - DNA, 620 bp, Artificial Sequence
  Synthetic polypeptide
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgagccgtctccagggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaataaatatttgctttg

SEQ ID NO: 11306 - DNA, 995 bp, Artificial Sequence
  Synthetic polypeptide
tcaagactaagatattcactcaaatgtacaattccacagaaattgaataacctgctcctgaatggcttttgggtaaataatgatattaaggcagaaataaagaaaatgagaacaaagatacaacatactggaatctctggggcacaggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattga

SEQ ID NO: 11307 - DNA, 916 bp, Artificial Sequence; identical to SEQ ID NO: 7516
  Synthetic polypeptide

SEQ ID NO: 11308 - DNA, 157 bp, Artificial Sequence; identical to SEQ ID NO: 7517
  Synthetic polypeptide

SEQ ID NO: 11309 - DNA, 424 bp, Artificial Sequence; identical to SEQ ID NO: 7518
  Synthetic polypeptide

SEQ ID NO: 11310 - DNA, 675 bp, Artificial Sequence; identical to SEQ ID NO: 7519
  Synthetic polypeptide

SEQ ID NO: 11311 - DNA, 732 bp, Artificial Sequence
  Synthetic polypeptide
tacttcaaaggacaccacgaagaaagtgaaagtacaacccacagattgggagacaattactgtaaatcattaatctaataataagggacttgtatctggaatatataaagaactcttacaactcaataacaaaaagacaaattatcccagcaacaactggcaaagggttcgaaaagatatttctccaaggacgatatacaagtggccaatagcacatgaaaagaagctcaacattattactcaccaggtgactgcaaatcaaagccgcatgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaa

SEQ ID NO: 11312 - DNA, 756 bp, Artificial Sequence
  Synthetic polypeptide
tacttcaaaggacaccacgaagaaagtgaaagtacaacccacagattgggagacaattactgtaaatcattaatctaataataagggacttgtatctggaatatataaagaactcttacaactcaataacaaaaagacaaattatcccagcaacaactggcaaagggttcgaaaagatatttctccaaggacgatatacaagtggccaatagcacatgaaaagaagctcaacattattactcaccaggtgactgcaaatcaaagccgcatgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacattccaggactttccaggatggggaaacatgcctgttctcgttctttgtatattcattttatgttctttattctcattctgaagacttggatcatctcctgtttttag

SEQ ID NO: 11313 - DNA, 455 bp, Artificial Sequence
  Synthetic polypeptide
tcccggttcaaaaccaccacttgctggttgaggagtcgtcagtaagtggctgcgcccccaccctgaggcttgtttctccatctgtacaatggaaatgatgaagatgcccacctgatagggtttttgtggcaaataagtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaa

SEQ ID NO: 11314 - DNA, 108 bp, Artificial Sequence
  Synthetic polypeptide
gccgagcacggtggctcacacctgtaaccccaccactttggaaggccgagggagtggttttcagagacatttcagaaagtgaaggagaaactcaagattgactcatga

SEQ ID NO: 11315 - DNA, 87 bp, Artificial Sequence
  Synthetic polypeptide
gccgagcacggtggctcacacctgtaaccccaccactttggaaggccgagggagtggttttcagagacatttcagaaagtgaaggag

SEQ ID NO: 11316 - DNA, 101 bp, Artificial Sequence
  Synthetic polypeptide
gccgagcacggtggctcacacctgtaaccccaccactttggaaggccgagggagtggttttcagagacatttcagaaagtgaaggagaaactcaagattga

SEQ ID NO: 11317 - DNA, 82 bp, Artificial Sequence
  Synthetic polypeptide
gccgagcacggtggctcacacctgtaaccccaccactttggaaggccgagggagtggttttcagagacatttcagaaagtga

SEQ ID NO: 11318 - DNA, 1131 bp, Artificial Sequence
  Synthetic polypeptide
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttga

SEQ ID NO: 11319 - DNA, 1098 bp, Artificial Sequence
  Synthetic polypeptide
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttga

SEQ ID NO: 11320 - DNA, 981 bp, Artificial Sequence
  Synthetic polypeptide
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggaggtgaacacacgcttcagcctaaaacactaa

SEQ ID NO: 11321 - DNA, 425 bp, Artificial Sequence
  Synthetic polypeptide
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcac

SEQ ID NO: 11322 - DNA, 239 bp, Artificial Sequence
  Synthetic polypeptide
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatga

SEQ ID NO: 11323 - DNA, 411 bp, Artificial Sequence
  Synthetic polypeptide
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgt

SEQ ID NO: 11324 - DNA, 942 bp, Artificial Sequence; identical to SEQ ID NO: 10396
  Synthetic polypeptide

SEQ ID NO: 11325 - DNA, 390 bp, Artificial Sequence; identical to SEQ ID NO: 10397
  Synthetic polypeptide

SEQ ID NO: 11326 - DNA, 206 bp, Artificial Sequence; identical to SEQ ID NO: 10398
  Synthetic polypeptide

SEQ ID NO: 11327 - DNA, 483 bp, Artificial Sequence; identical to SEQ ID NO: 10399
  Synthetic polypeptide

SEQ ID NO: 11328 - DNA, 978 bp, Artificial Sequence; identical to SEQ ID NO: 10400
  Synthetic polypeptide

SEQ ID NO: 11329 - DNA, 897 bp, Artificial Sequence; identical to SEQ ID NO: 10401
  Synthetic polypeptide

SEQ ID NO: 11330 - DNA, 660 bp, Artificial Sequence; identical to SEQ ID NO: 10402
  Synthetic polypeptide

SEQ ID NO: 11331 - DNA, 576 bp, Artificial Sequence; identical to SEQ ID NO: 10403
  Synthetic polypeptide

SEQ ID NO: 11332 - DNA, 639 bp, Artificial Sequence; identical to SEQ ID NO: 10404
  Synthetic polypeptide

SEQ ID NO: 11333 - DNA, 7888 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcatgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11334 - DNA, 7195 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcatgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11335 - DNA, 1019 bp, Artificial Sequence
  Synthetic polypeptide
tcaggcagaccctgggccccctcttctgaggcttctgtgctgcttcctggctctgaacagcgatttgacgctctctgggcctcggtttcccccatccttgagataggagatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactga

SEQ ID NO: 11336 - DNA, 713 bp, Artificial Sequence
  Synthetic polypeptide
tcaggcagaccctgggccccctcttctgaggcttctgtgctgcttcctggctctgaacagcgatttgacgctctctgggcctcggtttcccccatccttgagataggagatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctg

SEQ ID NO: 11337 - DNA, 794 bp, Artificial Sequence
  Synthetic polypeptide
tcaggcagaccctgggccccctcttctgaggcttctgtgctgcttcctggctctgaacagcgatttgacgctctctgggcctcggtttcccccatccttgagataggagatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacc

SEQ ID NO: 11338 - DNA, 723 bp, Artificial Sequence
  Synthetic polypeptide
tcaggcagaccctgggccccctcttctgaggcttctgtgctgcttcctggctctgaacagcgatttgacgctctctgggcctcggtttcccccatccttgagataggagatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagc

SEQ ID NO: 11339 - DNA, 543 bp, Artificial Sequence
  Synthetic polypeptide
ggctgggcgtggtggcttacacttgtaatccaaacgctttgggaggccaaggcaaacggatcacttgatgtcaggagttggagaccagcctggccaacatggtgaaaccccgtctctactaaaaatacaaaaattagacaggcatggtggtgcatgcttgtatttccagttactcaggaggctgaggcaggagaatcgctcgaacccggaagacagaggttgcggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaa

SEQ ID NO: 11340 - DNA, 1102 bp, Artificial Sequence; identical to SEQ ID NO: 7760
  Synthetic polypeptide

SEQ ID NO: 11341 - DNA, 1030 bp, Artificial Sequence; identical to SEQ ID NO: 7761
  Synthetic polypeptide

SEQ ID NO: 11342 - DNA, 898 bp, Artificial Sequence; identical to SEQ ID NO: 7762
  Synthetic polypeptide

SEQ ID NO: 11343 - DNA, 1002 bp, Artificial Sequence; identical to SEQ ID NO: 7528
  Synthetic polypeptide

SEQ ID NO: 11344 - DNA, 463 bp, Artificial Sequence
  Synthetic polypeptide
agcaaagcggttaagagcaccgactttggagtcggactccgggctgggatcccagctctgtgacccgggacaagtcacttaacctccctgagcctccttttccgcgtctgtgaagtggggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactga

SEQ ID NO: 11345 - DNA, 4027 bp, Artificial Sequence
  Synthetic polypeptide
ccctgaagagatactccaaaaggttagtccggaaacatgggcagatgggaggccagggaaaacaaaaactgcatctccagtacaagtcaagttttgtgcaggagtggcgctgccaaatctaaagcagcgccctttgagagaaaaggcacagcaatgcatttagcctctgctaatggccttcctgcaatacaggaagaattccttgtttctcatgtaacatacctgtcttgccaggacaaaaacatggaactgaggattattggtttgtacaggatttgagggctactaggcaaattttcaaagccatttatctggtgataactgatgcttatacattattcatgactttaaccagtgagttgtactggtgttcagtcttgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgacggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgagccactggcaccacttgtgatcttctccaggaggcagaagagttcactttgggttaacctagcactgtacacaccccatactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatataaattactgagcaagtgtgttctattcaaccagacatgaccaaaattccctttaaaaacctggacttaaaaatattcactgaggaaagcagctttatgcaccacggacaacagaaggctgagtatgctattgtaaccctgtgacagatcctagatgcagagacactccctctgggttcatcggcacagaaggcagaacttagagtcctaatcagggcatcccaactaggtaaagactcctgagtcaccgattactctgattccagaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatag

SEQ ID NO: 11346 - DNA, 548 bp, Artificial Sequence
  Synthetic polypeptide
gtctccagatgtgtcacctggagaaggacatcatagcacttttgtagtgttacagctggggtccagaacctgaatccaatcatgaagaaatatcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctga

SEQ ID NO: 11347 - DNA, 1046 bp, Artificial Sequence; identical to SEQ ID NO: 631
  Synthetic polypeptide

SEQ ID NO: 11348 - DNA, 968 bp, Artificial Sequence; identical to SEQ ID NO: 632
  Synthetic polypeptide

SEQ ID NO: 11349 - DNA, 676 bp, Artificial Sequence; identical to SEQ ID NO: 634
  Synthetic polypeptide

SEQ ID NO: 11350 - DNA, 494 bp, Artificial Sequence; identical to SEQ ID NO: 635
  Synthetic polypeptide

SEQ ID NO: 11351 - DNA, 1196 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11352 - DNA, 644 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11353 - DNA, 460 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11354 - DNA, 737 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11355 - DNA, 1232 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11356 - DNA, 1151 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11357 - DNA, 914 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11358 - DNA, 830 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11359 - DNA, 893 bp, Artificial Sequence
  Synthetic polypeptide
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11360 - DNA, 1052 bp, Artificial Sequence; identical to SEQ ID NO: 447
  Synthetic polypeptide

SEQ ID NO: 11361 - DNA, 1118 bp, Artificial Sequence; identical to SEQ ID NO: 448
  Synthetic polypeptide

SEQ ID NO: 11362 - DNA, 398 bp, Artificial Sequence
  Synthetic polypeptide
aagggctcacgggagagttttccattacaaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactga

SEQ ID NO: 11363 - DNA, 1227 bp, Artificial Sequence
  Synthetic polypeptide
tgtagaaggcagtttctataatggatctcaatgatccccacccgctatgttcactcccttgtgtgatcttttccctttgaatatggagtggatctaggaacttgcttctaatgcacagaatgcagctaaagtgatggaatggcccttccgagatcagattacaagagtgtggcttctgccttctctctctgtctgattcttctcactggctagatctgatgaagcaagctgctcttgggagctgccctgtgaggaggcccacacagcaaggaacaaaggaggagcaaccggatcctgcaacaaacaagtgactgggctgctgtttccccagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggcgggctttctgagcctgatcccggcctgggccttctacagcggtgccttccaaaggctgctcctgacacactatgtggcatacctgaagctcaacaccaaggtcaggtag

SEQ ID NO: 11364 - DNA, 1077 bp, Artificial Sequence
  Synthetic polypeptide
tgtagaaggcagtttctataatggatctcaatgatccccacccgctatgttcactcccttgtgtgatcttttccctttgaatatggagtggatctaggaacttgcttctaatgcacagaatgcagctaaagtgatggaatggcccttccgagatcagattacaagagtgtggcttctgccttctctctctgtctgattcttctcactggctagatctgatgaagcaagctgctcttgggagctgccctgtgaggaggcccacacagcaaggaacaaaggaggagcaaccggatcctgcaacaaacaagtgactgggctgctgtttccccagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggcgggctttctgagcctgatcccggcctgggccttctacagcggtgccttccaaaggctgctcctgacacactatgtggcatacctgaagctcaacaccaaggtcaggtag

SEQ ID NO: 11365 - DNA, 1598 bp, Artificial Sequence
  Synthetic polypeptide
gctgggcacgatggttctcacctgcaatcccagcactttaggaggccaagacaggaggatcgcttgaggccaggaattcaaggcaacacgagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctga

SEQ ID NO: 11366 - DNA, 446 bp, Artificial Sequence
  Synthetic polypeptide
gctgggcacgatggttctcacctgcaatcccagcactttaggaggccaagacaggaggatcgcttgaggccaggaattcaaggcaacacgagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggctggagtgcagtggtgcaatcttggctcactgcaacctccacctcccgggttcaagtgattcttctgcctcagactccagagtatctaggattacaggaagctcaaaggccctgtggccccccaagaatggcaggggagcctcctag

SEQ ID NO: 11367 - DNA, 1079 bp, Artificial Sequence; identical to SEQ ID NO: 6652
  Synthetic polypeptide

SEQ ID NO: 11368 - DNA, 1103 bp, Artificial Sequence
  Synthetic polypeptide
gcgcaggtgctggaatccgagggcctggttaagagcctccgctcagttgctgattggctggagatgaagttacttagcgtctctgagcttcaagctctccatctgcccaactggggaaagcagtgccttcttttcagggctttggtgagagctaaatgagatagaccgtgtatgcattgcttgcttgggagttcatgagcggcccagttctgtaccaggagaagctgctgaagccggcagctttgctgctggagaagggtgccgaccaggaggaagacgaggccctgcgggtgctgtccctgcgcgccctcggcaacatggccctgggcgcccccaagaaggtgaagcagtaccggaaggtcttgctggagaagtgcctgggccccctgagggagcccgtgagcaacagcgtgactgccgagggcatggaggccctgaccaagatcctggctgagctccgggaaggggatgtggggtcctctttcgacgccatgtctgagcagtgcaggatcttcttcgacaacgagagcgagctgctgcgtctgaaagccttcatcctctttggaaagctggcaagggtggtcgggatgtccaagaagcatttcttcaaaggggaggtgaagaaggcctggatccccctcatgctgcactcccaggacccctgctccaatgcagcccaagcctgtatggctaccatgtttcagtgtgtgcacttctggggctggaagtccctggagcatccctcagggccaagtgataccgctactgatgacaagatgaccgttttccagacaaccatgtgctccatcctgactcggaaaaagccggctgttctctaccgcttcttgctagaaacaatggcctatgttaaaaataacttgtcaagaatcagaatcgctgcttgcaacttggcaggaattattatgaagcagatgtctacacattatctgaaaaagctggacttcccagcattacggaattccctccaggaactacagctggacccggatcccggggtcaggagggcagccctggagacgctcacagtcttggatagctgtagtcagcatgggtttctggcttcaccccaaggaatgtcctag

SEQ ID NO: 11369 - DNA, 1450 bp, Artificial Sequence
  Synthetic polypeptide
acaggggtgaaaagcataggttctgacttcagactgctgggccgcagccctggctatcccaccccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctag

SEQ ID NO: 11370 - DNA, 1372 bp, Artificial Sequence
  Synthetic polypeptide
acaggggtgaaaagcataggttctgacttcagactgctgggccgcagccctggctatcccaccccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctag

SEQ ID NO: 11371 - DNA, 1390 bp, Artificial Sequence
  Synthetic polypeptide
acaggggtgaaaagcataggttctgacttcagactgctgggccgcagccctggctatcccaccccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcgggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctag

SEQ ID NO: 11372 - DNA, 522 bp, Artificial Sequence
  Synthetic polypeptide
aaagaatgtggactttggagtcaaactaatatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctag

SEQ ID NO: 11373 - DNA, 86 bp, Artificial Sequence
  Synthetic polypeptide
aaagaatgtggactttggagtcaaactaatatcactggcaagtggttttatatcgcatcggcctttcgaaacgaggagtacaataa

SEQ ID NO: 11374 - DNA, 715 bp, Artificial Sequence
  Synthetic polypeptide
ggctaggcgcggtggctcacgcctgtcatcccagcactttgggaggccgaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaa

SEQ ID NO: 11375 - DNA, 566 bp, Artificial Sequence
  Synthetic polypeptide
aatcctggctccactccttactagctgtgtgaccctggacaaattggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatga

SEQ ID NO: 11376 - DNA, 1090 bp, Artificial Sequence
  Synthetic polypeptide
ccttcctagctctcagttttctcatctgtaaaatggaagtgacagtaccgactatgaattaaatgagccattgtttgggaacttggcacgtttcccggcgcacggtatcatacatgcgctacagagggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactga

SEQ ID NO: 11377 - DNA, 748 bp, Artificial Sequence
  Synthetic polypeptide
ccttcctagctctcagttttctcatctgtaaaatggaagtgacagtaccgactatgaattaaatgagccattgtttgggaacttggcacgtttcccggcgcacggtatcatacatgcgctacagagggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgagtgaatggccttgagcaagccacacaggcaggaccattcatgaagtggactaaggcacgacaagttcccagcacgatgctcaccaaagatacaaatccgggtctaggatggcccctgggcctggtcctgttattcactcctctctcctgctctgtgacctag

SEQ ID NO: 11378 - DNA, 2972 bp, Artificial Sequence
  Synthetic polypeptide
gtgacgttaagtcttcatagggagaaggtgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggttttgtttctggaaggcaacccgctcttacttacagtatag

SEQ ID NO: 11379 - DNA, 3248 bp, Artificial Sequence
  Synthetic polypeptide
gtgacgttaagtcttcatagggagaaggtgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggtgaatgtccctgagttccagaaggatgccatccttgctgccatcacagagggctacctagatcggagcgtcttccatggggctatcatgtctgtcttccccgttgttatgtacttctggaaaaggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaa

SEQ ID NO: 11380 - DNA, 500 bp, Artificial Sequence
  Synthetic polypeptide
gtgacgttaagtcttcatagggagaaggtgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaatgctcagtccctggtatga

SEQ ID NO: 11381 - DNA, 482 bp, Artificial Sequence
  Synthetic polypeptide
gtgacgttaagtcttcatagggagaaggtgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattgtactggcagaatctgtatgatatgctcagtccctggtatgatgagtttctag

SEQ ID NO: 11382 - DNA, 1082 bp, Artificial Sequence
  Synthetic polypeptide
ttccctttcctagccaagggaagccctgacagatggtacctggaaaatcaggacactcccaccctaatactgcacttttccaatggtcttagcaaacggcacaccaggagattatatcccgcgcatggctcagagggtcccatgcccacagagcctcgctaactgctagcacagcagtctgaaatagaactgcagggtggcagtgagactgggggaggggtgtccgccagtgctggggcttgagtaggtaaacaaagtagcctggaagctcaaactgggtggagcccaccacagctcaaggaggcctgccttcctgcctctatagactccacctctaggggcaggacatagctgaacaaaaggcagcagaaacttctgcagacttaaatgtccctgtctgacagctttgaagagagtagtggttctcccagcatggagttggagatctgagaacggacagactggcccctcaactgggcccttgacccccgagtagcctaactgggagacacctcccagtaggggccaactgacacctcatacagccaggtgcccctctgagacgaagcttccagaggaaggatcaggcagcaacatttgccattctacaatatttgctgttctgcagcctccactggtgatacccaggcaaacagtgtctgcagtggacgtccagcaaactccaacagacctgcagctcagggtcctgactgttagaaggaaaactaacaaacagaaaggacatccacaccaaaaccccgtttgtatgtcaccatcacgaaagaccaaaggcagataaaaccacaaagatggggagaaaccagagcagaaaagctgaaaattctgaaattcagagcgcctcttctcttccaaaggaatgcagctcctcgccagcaacggaacaaagctggacggagaatgactttgacgagttgagagaagaaggcttcagatgattggtcattaaatttgacggtggagaggaagtacttatttcaggggaattcaacgacctgagaaaggtcaccaaggagcagtgggacaccatagaagaactcatcaggaagacaaaaggttcctaa

SEQ ID NO: 11383 - DNA, 967 bp, Artificial Sequence
  Synthetic polypeptide
ttccctttcctagccaagggaagccctgacagatggtacctggaaaatcaggacactcccaccctaatactgcacttttccaatggtcttagcaaacggcacaccaggagattatatcccgcgcatggctcagagggtcccatgcccacagagcctcgctaactgctagcacagcagtctgaaatagaactgcagggtggcagtgagactgggggaggggtgtccgccagtgctggggcttgagtaggtaaacaaagtagcctggaagctcaaactgggtggagcccaccacagctcaaggaggcctgccttcctgcctctatagactccacctctaggggcaggacatagctgaacaaaaggcagcagaaacttctgcagacttaaatgtccctgtctgacagctttgaagagagtagtggttctcccagcatggagttggagatctgagaacggacagactggcccctcaactgggcccttgacccccgagtagcctaactgggagacacctcccagtaggggccaactgacacctcatacagccaggtgcccctctgagacgaagcttccagaggaaggatcaggcagcaacatttgccattctacaatatttgctgttctgcagcctccactggtgatacccaggcaaacagtgtctgcagtggacgtccagcaaactccaacagacctgcagctcagggtcctgactgttagaaggaaaactaacaaacagaaaggacatccacaccaaaaccccgtttgtatgtcaccatcacgaaagaccaaaggcagataaaaccacaaagatggggagaaaccagagcagaaaagctgaaaattctgaaattcagagcgcctcttctcttccaaaggaatgcagctcctcgccagcaacggaacaaagctggacggagaatgactttgacgagttgagagaagaaggcttcagatgattggtcattaa

SEQ ID NO: 11384 - DNA, 343 bp, Artificial Sequence; identical to SEQ ID NO: 891
  Synthetic polypeptide

SEQ ID NO: 11385 - DNA, 780 bp, Artificial Sequence
  Synthetic polypeptide
acgggctttggaactggacctggctctaaatctcagctctgacacgctcagctgtgtggtttggaacgagctgttgaacctctggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttga

SEQ ID NO: 11386 - DNA, 264 bp, Artificial Sequence
  Synthetic polypeptide
acgggctttggaactggacctggctctaaatctcagctctgacacgctcagctgtgtggtttggaacgagctgttgaacctctggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctc

SEQ ID NO: 11387 - DNA, 419 bp, Artificial Sequence
  Synthetic polypeptide
acgggctttggaactggacctggctctaaatctcagctctgacacgctcagctgtgtggtttggaacgagctgttgaacctctggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcag

SEQ ID NO: 11388 - DNA, 1647 bp, Artificial Sequence
  Synthetic polypeptide
tgcagaacagttatgctggtggccttgaactgacccagttctctcttttttgcttgtagttctcaaaaataactagaatattctgtgaatgcaacatccagtgataaggagcgactggctggaacagcctgggctctgttccagtcccccctagaaacaggatgtccttcaacactttagcccagcatgtcatgttacccctggggtataaagcccagggtgggctgctatccagggtccctcagctgcggcgcaagtggagtatgtacaaacaaagcttcatctaccttggtaactttcctgagccttggaagaccagctcaacatgaatcctaggcttctgctgtcctttgctgtctttctgtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtga

SEQ ID NO: 11389 - DNA, 522 bp, Artificial Sequence
  Synthetic polypeptide
tgcagaacagttatgctggtggccttgaactgacccagttctctcttttttgcttgtagttctcaaaaataactagaatattctgtgaatgcaacatccagtgataaggagcgactggctggaacagcctgggctctgttccagtcccccctagaaacaggatgtccttcaacactttagcccagcatgtcatgttacccctggggtataaagcccagggtgggctgctatccagggtccctcagctgcggcgcaagtggagtatgtacaaacaaagcttcatctaccttggtaactttcctgagccttggaagaccagctcaacatgaatcctaggcttctgctgtcctttgctgtctttctgtgcagcagttcctgcggcaagcccagcgggggacagaggaaaaggagagagagggggctctggtcagccttcgtcgaggcttgcagcaccctgaaacacagcaaaccttcatccggtcagtgtggatggtgtggtggagggaggagttggggctctga

SEQ ID NO: 11390 - DNA, 458 bp, Artificial Sequence
  Synthetic polypeptide
tgcagaacagttatgctggtggccttgaactgacccagttctctcttttttgcttgtagttctcaaaaataactagaatattctgtgaatgcaacatccagtgataaggagcgactggctggaacagcctgggctctgttccagtcccccctagaaacaggatgtccttcaacactttagcccagcatgtcatgttacccctggggtataaagcccagggtgggctgctatccagggtccctcagctgcggcgcaagtggagtatgtacaaacaaagcttcatctaccttggtaactttcctgagccttggaagaccagctcaacatgaatcctaggcttctgctgtcctttgctgtctttctgtgcagcagttcctgcggcaagcccagcgggggacagaggaaaaggagagagagggggctctggtcagccttcgtcgaggcttgcagcaccctga

SEQ ID NO: 11391 - DNA, 1665 bp, Artificial Sequence
  Synthetic polypeptide
tgcagaacagttatgctggtggccttgaactgacccagttctctcttttttgcttgtagttctcaaaaataactagaatattctgtgaatgcaacatccagtgataaggagcgactggctggaacagcctgggctctgttccagtcccccctagaaacaggatgtccttcaacactttagcccagcatgtcatgttacccctggggtataaagcccagggtgggctgctatccagggtccctcagctgcggcgcaagtggagtatgtacaaacaaagcttcatctaccttggtaactttcctgagccttggaagaccagctcaacatgaatcctaggcttctgctgtcctttgctgtctttctgtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccccctgcttctgccagcagctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtga

SEQ ID NO: 11392 - DNA, 1025 bp, Artificial Sequence
  Synthetic polypeptide
agcctacagattcagagtgtgcgttccagagccaggctctccaggtctgaatcttagccgtgtgacttcgggcaagtgacttaatgtctctgtgcttcaacgtcctcacctagagaatggagatgataatagtacttttgcataatgttgctgtgaggatgaacgagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaa

SEQ ID NO: 11393 - DNA, 1052 bp, Artificial Sequence; identical to SEQ ID NO: 789
  Synthetic polypeptide

SEQ ID NO: 11394 - DNA, 974 bp, Artificial Sequence; identical to SEQ ID NO: 790
  Synthetic polypeptide

SEQ ID NO: 11395 - DNA, 682 bp, Artificial Sequence; identical to SEQ ID NO: 792
  Synthetic polypeptide

SEQ ID NO: 11396 - DNA, 500 bp, Artificial Sequence; identical to SEQ ID NO: 793
  Synthetic polypeptide

SEQ ID NO: 11397 - DNA, 6357 bp, Artificial Sequence
  Synthetic polypeptide
aagatggccaaacaggaacagctccagtctacagctcccagcgtgagcaacacagaagacgaatgatttctgcatttccaactgaggtaccgggtgcatctcaatggggattgttggagagtgggtgcaggacagtgggtgcagtgcacccagcctgagccaaagcagggcgaggcatcacctcacctgggaagtgcaaggggtcagggaattccctttcctaggggtgacggacagcacctggaaaatcaggtcactcccaccctaatactgcgcttttctgatggtcttagcaaacggcacaccaggagattatatcccgcgcatggctcggagggtcctacgcccatggagcctcgctcattgctagcacagcagtctgagatcgaactgcaaggcagcagcaaggctgggggaggggcgcccgccattgctaaggcttgagtaggtaaacaaagctgccaggaagctcaaactgggtgaagcccaccgcagctcaaggaggtctgcctgcctctgtagactccacctctaggggcagagcatagccaaccaaaaggcagcagaaacctctgcagacttaaatgtccctgtctgacagctttgaagagagtagtggttctcccagcacacagctggagatctgagaacagacagactgcctcctcaagtgggtccctgacccccgagcagcctaactgggaggcaccccccagtaggggcagactgacacctcacacggccgggtactcctctgagacaaaacttccagaggaatgatcaggcagcagcatttgcgggtcaccaataccgctgttctgcagcctccactcctgatacccaggcaaacagggtctggagtggacctccggcaaactccaacagacctgcagctgaggatcctgactgtcagaaggaaaactaacaaacagaaaggacatccacaccaaaacccatctgtacatcaccatcatcaaagatcaaaggtagataaaaacacaaagatgggggaaaaacagcagaaaaactgaaaaatctaaaaatcagagcacctctcctcctccaaaggaacgcagctccgcaccagcaacggaaagctggatggagaatgactttgacgagttgagagaagaaggcttcagacgatcaaactactccgagctaaaggaggaagttcgaacccatggcaaagaagttaaaaaccttgaaaaaagattagacaaatggctaactagaataatcaatgcagagaagtccttaaaggacctgatggagctgaagaccatggcacgagaactacgtgatgaatgcacaagcctcagtagccaattcaatcaactggaagaaagggtatcagtgatggaagatcaaatgaatgaaatgaagaaagaagagaagtttagaagaaaaagaataaaaagaaaggaacaaagcctccaagaaatatgggactatgtgaaaagaccaaatctacgtctgattggtgtacctgaaagtgacggggagaatagaacgaagttggaaaacactctgcaggatattatccaggagaacttccccaatctagcaaggcaggccaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccacaaacacaaacccatcagactaacagtggatctctcggcagaaactctacaagccagtagagagtgggggccaatattcaacattcttaaagaaaagaattttcaacccagaatttcatttccagccaaactaagcttcataagtgaaggagaaataaaatactttacagacaagcaaatgctgagagattttgtcaccaccaggcctgccctaaaagagctcttgaaggaagcactaaacatggaaaggaacaactggtaccagccactgcaaaaacatgccaaattgtaaagaccatcgaggctaaggagaaactgcatcaactaacgagcaaaataatcagctaacatcataatgacaggatcaaattcacatataaaaatattaaccttaaatgtaaacgggctaaatgctccaattaaaagacacagactggcaaactggatagagtcaagacccatcggtgtgctgtattcaggaaacccatctcacgtgcaaagtaacacataggctcaaaataaagggatggaggaagatctaccaagcaaatggacaacaaaaaaaggcaggggttgcaatcctactctctgataaaacaggctttaaaccaacaaagatcaaaagagacaaagaaggccattacataatggtaaagggatcaattcaacaagaagagctaactatcctaaatatatatgcacccaatacaggagcacccagattcatgaagcaagtctttagagacttacaaagagagttagactcccacacaataataatggaagactttaacaccacactgtcaacactagacagatcaacaggacagaaagttaagaaggatatccaggaattgaactcagctctgcacaaagtggacataatagacatctacagaactctccaccccaaatcaacagaatatacattcttttcagcaccacaccacacctattccaaaattaaccacatagttggaagtaaagcactcctcagcaaatgtaaaagaacagacattataacaaactgtctctcagaccacagtgcaatcaaactagaactcaggattcagaaactcactcaaaaccgctcaactacatggaaactgaacaacctgctcctgaatgactactgggtacataacgaaatgaaggcagaaataaagatgttctttgaaaccaacaagaacaaagacacaacataccagaatctctgggccacattcaaagcaatgtgtagagggaaatttatagcactaaatgcctacaagagaaagcaggaaagatctaacattgacaccctaacatcacaatgaaaagaactagagaagcaggagcaaacacattcaaaagatagcagaaggcaagaaataactaagatcagagcagaactgaaggaaacagagacacaaaaaaacccttcaaaaaaatcaatgaatccaggagctggttttttgaaaagatcaacaaaattgatagaatgctagcaagactaataaagaagaaaagagagaagaatcaaatagatgcaataaaaatgataaaggggatatcaccacccatcccacagaaatacaaactaccatcagagaatactataaacacctctatgcaaataaactagaaaatctagaagaaatggataaattcctcgacacatacactctcccaagactaaaccaggaagaagttgaaactctgaatagaccaataacaggttctgaaattgaggcaataattaatagcttaccaaccaaaaaaagtccaggaccagatggattcaccgccgaattctaccagaggtacaaggaggacctggtaccattctttctgaaactattccaatcaatagaaaaagagggaatcctccctaactcattttatgaggccagcatcatcctgataccaaagcctggcagagacacaaccaaaaaagagaattttagaccaatatccctgatgaacagtgatacaaaaatcctcaataaaatactggcaaaccgaatccagcagcacatcaaaaagcttatccaccatgatcaagtgggcttcatccctgggatgcaaggctggttcaacatacgcaaatcaataaacataatccagcatataaacagaaccaacgacaaaacccacatgattatctcaatagatgcagaaaaggcctttaacaaaattcaacagcccttcatgctaaaaactctgaataaattaggtattgatggaacctatctcaaaataataagagcaaatttatgacaaacccacagccaatatcatactgaatggacaaaaactggaatcattccctttgaaaactggcacaagacagggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatctagaaaaccccatcgtctcagcccaaaatctccttaagctgataaacaacttcagcaaagtatcaggatacaaaatcaatgtgcaaaaatcacaaatattcttatacaccaataacagacaaacagagagccaaatcatgagtgaactcccattcacaattgcttcaaagacaataaaatacctaggaattcaacttacaagggatgtgaaggacctcttcaaggagaattacaaaccactgctcaatgaaataaaagaagatacaaacaaatggaacaacattccatgctcatgggtaggaagaatcaatatcatgaaaatggccatactgcccaaggtaatttatagattcagtgccatcgccatcaagctaccaatgactttcttcacagaactggaaaaaactactttaaagttcatatggaaccaaaaaagagcccgcattgccaagtcaatcctaagccaaaagaacaaagccggaggcatcatgctacctgacttcaaactatactacaaggctacagtaaccaaaacagcatggtactggtaccaaaacagagatattgatcaatggagcagaacagagccctgagaaagaatgccacatatctacaaccatctgatctttgacaaacctgacaaaaacaagcagtggggaaaggattccctatttaataaatggtgctgggaaaactggctagccatatatagaaagctgaaactggatcccttccttacaccttatacaaaaattaattcaagatggattaaagacttacatgttagacctaaaaccataaaaaccctagaagaaaacctaggcaatatcattcaatacagaggcatgggcaaggacttcatgtctaaaacaccaaaagcaatggcaacaaaagccaaaattgacaaatgggatctaatgaaactaaagagcttctgcacagcaaaagaaactaccatcagagtgaacaggcaaccgacagaatgggagaaaatttttgcaacctactcatctgacaaagggctaatatccagaatctacaatgatctcaaacaaatttacaagaaaaaaacacaaccccatcaacaagtgggggaaggatatgaacagacacttctcaaaagacatttatgcagccaatagacacatgaaaaaatgttcatcatcactggccatcaaagaaatgcaaatcaaaaccacaatgagataccatctcacgccagttagaatggcgatcattaaaaagtcaggaaacaacaggtgctggagaggatgtggagaaaacaggaacacttttacactgttggtgggactgtaaactagttcaaccattgtggaagtcagtgtggtgattcctcagggatctagaactagaaataccatttgacccagccatcccattactgggtatatacccaaaggattataaatcatcctgctataaacacacatgcacacttatgtttattgcagcactattcacaatagcaaagacttggaaccaacccaaatgtccaataatgatagactggattaagaaaatgtggcacatatacaccatggaatgctatgcagccataaaaaatgatgagttcatgtcctttgtagagacatggatgaagctggaaaccatcattctcagcaaactatggcaaggacaaaaaaccaaacactgcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatga

SEQ ID NO: 11398 - DNA, 625 bp, Artificial Sequence; identical to SEQ ID NO: 6804
  Synthetic polypeptide

SEQ ID NO: 11399 - DNA, 598 bp, Artificial Sequence; identical to SEQ ID NO: 6805
  Synthetic polypeptide

SEQ ID NO: 11400 - DNA, 1911 bp, Artificial Sequence; identical to SEQ ID NO: 10254
  Synthetic polypeptide

SEQ ID NO: 11401 - DNA, 804 bp, Artificial Sequence; identical to SEQ ID NO: 10255
  Synthetic polypeptide

SEQ ID NO: 11402 - DNA, 531 bp, Artificial Sequence; identical to SEQ ID NO: 10256
  Synthetic polypeptide

SEQ ID NO: 11403 - DNA, 494 bp, Artificial Sequence; identical to SEQ ID NO: 10257
  Synthetic polypeptide

SEQ ID NO: 11404 - DNA, 398 bp, Artificial Sequence
  Synthetic polypeptide
acttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccggacaagaccgccacccttgttggaagggagacaggcaagagctcccagctcctccagcagccgacaggaggcccgtcaagatgcaggcaggcattgccaccccagggatgaagacagcagcccaggcaaaggccaagaccacaggagcctcccggtctcatcctgcaaaagctaaaggctgccagaggccccccaagatccgtaactacaacattatggactga

SEQ ID NO: 11405 - DNA, 349 bp, Artificial Sequence
  Synthetic polypeptide
acttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccggacaagaccgccacccttgttggaagggagacaggcaagagctcccagctcctccagcagccgacaggaggcccgtcaagatgcaggcaggcattgccaccccagggatgaagacagcagcccaggcaaaggccaagaccacaggagcctcccggtctcatcctgcaaaagctaa

SEQ ID NO: 11406 - DNA, 1137 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11407 - DNA, 585 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11408 - DNA, 401 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11409 - DNA, 678 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11410 - DNA, 1173 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11411 - DNA, 1092 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11412 - DNA, 855 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11413 - DNA, 771 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11414 - DNA, 834 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11415 - DNA, 768 bp, Artificial Sequence
  Synthetic polypeptide
ggccgggcgcagcggctcaagcctgtaatcccggcactttgagaggccgaggtgggcggatcacgagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaa

SEQ ID NO: 11416 - DNA, 552 bp, Artificial Sequence
  Synthetic polypeptide
ggccgggcgcagcggctcaagcctgtaatcccggcactttgagaggccgaggtgggcggatcacgagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgat

SEQ ID NO: 11417 - DNA, 1172 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11418 - DNA, 479 bp, Artificial Sequence
  Synthetic polypeptide
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11419 - DNA, 1120 bp, Artificial Sequence
  Synthetic polypeptide
ttccagcagttcagttttaattgttcatttgtttgtggaatcatttcagtgtttggctctgcccacttggatgtaagctccaggagctctgggagaccaagtacaccatctgttttgcccattgctggaactccgtggttgggcacctgcctggcacctaattttccgccgtgcggacaaaaatgatgatgggaagctgtccttggaggaattccagctcttctttgcagatggcgtccttaatgagaaagaactggaggatctctttcacacgattgactctgacaacaccaaccatgtggacaccaaggagctgtgtgattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaagcactgtggttcgacctgcagcagcgcctgtcagatgaagatggcaccaacatgcacctgcagctggtccggcaggagatggccgtgtgccccgagcaactgagcgagtttctggactctctgcgccagtatctgcgggggaccactggcgtgaggaactgcttccacatcactgccgtgaggctctcagatggcttcacctttgtcatctatgagttctgggagacagaggaggcgtggaagaggcacctgcagagccccctgtgtaaggcgttccggcacgtcaaggtggacacactgagccagcctgaggccctctccaggatcttggtgccagctgcttggtgcacggtgggacgggactga

SEQ ID NO: 11420 - DNA, 924 bp, Artificial Sequence; identical to SEQ ID NO: 7243
  Synthetic polypeptide

SEQ ID NO: 11421 - DNA, 963 bp, Artificial Sequence; identical to SEQ ID NO: 7244
  Synthetic polypeptide

SEQ ID NO: 11422 - DNA, 580 bp, Artificial Sequence
  Synthetic polypeptide
gtggcaggctgaagaatggcccctaaagtgtccatgtcctgatccccagaaccttggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtga

SEQ ID NO: 11423 - DNA, 1327 bp, Artificial Sequence
  Synthetic polypeptide
tttctgggggcctgtctgggatttctccaaagcgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtga

SEQ ID NO: 11424 - DNA, 508 bp, Artificial Sequence
  Synthetic polypeptide
tttctgggggcctgtctgggatttctccaaagcgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccatacca

SEQ ID NO: 11425 - DNA, 278 bp, Artificial Sequence; identical to SEQ ID NO: 8451
  Synthetic polypeptide

SEQ ID NO: 11426 - DNA, 136 bp, Artificial Sequence; identical to SEQ ID NO: 8452
  Synthetic polypeptide

SEQ ID NO: 11427 - DNA, 93 bp, Artificial Sequence
  Synthetic polypeptide
ctccaagatcatgacaactggcccaagggagcaggggacctttctgttgtcaaaaagatgaaggagacctttaaggagaaagctaagctctga

SEQ ID NO: 11428 - DNA, 883 bp, Artificial Sequence; identical to SEQ ID NO: 9631
  Synthetic polypeptide

SEQ ID NO: 11429 - DNA, 630 bp, Artificial Sequence
  Synthetic polypeptide
tgtggcagaaactgcttagtgtcccctaatatccattcttccccttttctacagtataaagcccctccttccacgttttagctgggctcatggctgcccacttcatttcctagcccaccttggcaaccagattttgccatttgattaaggtctggccagagggaagtatgaggaagtgacgtgtataacattctggagtgtgtttactgaagagaggggctggacccttccaactcctgccatcctgctacaggaaaggcaccaatgcccagacctggctacaagccccaagagcccaatggctgcggctcctatttcctgggtctcaaggtaccagaaagtatggacttgggcattccagcaatgacaaagtgctgcaaccagctggatgtctgttatgacacttgcggtgccaacaaatatcgctgtgatgcaaaattccgatggtgtctccactcgatctgctctgaccttaagcggagtctgggctttgtctccaaagtggaagcagcctgtgattccctggttgacactgtgttcaacaccgtgtggaccttgggctgccgcccctttatgaatagtcagcgggcagcttgcatctgtgcagaggaggagaaggaagagttatga

SEQ ID NO: 11430 - DNA, 820 bp, Artificial Sequence
  Synthetic polypeptide
gccaggcgcagtggctcacgcctgtaatcccagcacttggggaggccgaggcaggcagatcatgaggtcaggagatcgagaccatcctggctaacatggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataa

SEQ ID NO: 11431 - DNA, 376 bp, Artificial Sequence; identical to SEQ ID NO: 10759
  Synthetic polypeptide

SEQ ID NO: 11432 - DNA, 568 bp, Artificial Sequence
  Synthetic polypeptide
agtatggtgatttctcaaaaaactaaacagaactaccatatgatccagcaatcccactactgggtatttatccaaaggaaaagaaatcagcatatcaaaaagatgtctacactcccatgttaattgcagcactattcacaatacgaagatatgggatcaacctaagtatccaatggatgaaaggataaataatatgtggtatatatacacaatggaatactatttggcattaaaaaagagtgaaatcatgtcatctgcagcaacatggagagaactggaggtcattatgttaactgaagtaagccaggcacagaaaataaatatcacgtgtttgcactcataagtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtga

SEQ ID NO: 11433 - DNA, 1088 bp, Artificial Sequence
  Synthetic polypeptide
gggaaatgcaaaccataactacagtgaggtatcaccttatacccattaggataatcactatcaaaagaacagaaattggcaaatgttagcaaagttgcatagaaattggaacgcttgtacactgttggtaggaatgtaaagtggttcaatcattatggaaaacagtatggaagtccctcaaaacattaaaaatagaattaacatgtaatccatcaattccacttctgggtatatatcttaaaaattcaaagtgggatctcaaagagatttgcacttccatgttcactgcagaattattcacaataaccaagaggtggaagcaacccatatgtccatcaacagatgaatggatgaagacaatgtgcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagattgatgctgaattgaagaatatcctgtag

SEQ ID NO: 11434 - DNA, 1094 bp, Artificial Sequence
  Synthetic polypeptide
gggaaatgcaaaccataactacagtgaggtatcaccttatacccattaggataatcactatcaaaagaacagaaattggcaaatgttagcaaagttgcatagaaattggaacgcttgtacactgttggtaggaatgtaaagtggttcaatcattatggaaaacagtatggaagtccctcaaaacattaaaaatagaattaacatgtaatccatcaattccacttctgggtatatatcttaaaaattcaaagtgggatctcaaagagatttgcacttccatgttcactgcagaattattcacaataaccaagaggtggaagcaacccatatgtccatcaacagatgaatggatgaagacaatgtgcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagaccagagttggagccacccaggggaatgatctctga

SEQ ID NO: 11435 - DNA, 710 bp, Artificial Sequence
  Synthetic polypeptide
gggaaatgcaaaccataactacagtgaggtatcaccttatacccattaggataatcactatcaaaagaacagaaattggcaaatgttagcaaagttgcatagaaattggaacgcttgtacactgttggtaggaatgtaaagtggttcaatcattatggaaaacagtatggaagtccctcaaaacattaaaaatagaattaacatgtaatccatcaattccacttctgggtatatatcttaaaaattcaaagtgggatctcaaagagatttgcacttccatgttcactgcagaattattcacaataaccaagaggtggaagcaacccatatgtccatcaacagatgaatggatgaagacaatgtgcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataaggccctctactaa

SEQ ID NO: 11436 - DNA, 249 bp, Artificial Sequence; identical to SEQ ID NO: 492
  Synthetic polypeptide

SEQ ID NO: 11437 - DNA, 38 bp, Artificial Sequence; identical to SEQ ID NO: 491
  Synthetic polypeptide

SEQ ID NO: 11438 - DNA, 3076 bp, Artificial Sequence
  Synthetic polypeptide
gtaatgctggcataaaaaaacctactgcactgccagtcctataaaagcatacagtaatgtcccaggccttcacattcactcaccactcactgattcacccagaacaacttccagtcctgcaagctccattcatgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggttttgtttctggaaggcaacccgctcttacttacagtatag

SEQ ID NO: 11439 - DNA, 3352 bp, Artificial Sequence
  Synthetic polypeptide
gtaatgctggcataaaaaaacctactgcactgccagtcctataaaagcatacagtaatgtcccaggccttcacattcactcaccactcactgattcacccagaacaacttccagtcctgcaagctccattcatgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggtgaatgtccctgagttccagaaggatgccatccttgctgccatcacagagggctacctagatcggagcgtcttccatggggctatcatgtctgtcttccccgttgttatgtacttctggaaaaggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaa

SEQ ID NO: 11440 - DNA, 604 bp, Artificial Sequence
  Synthetic polypeptide
gtaatgctggcataaaaaaacctactgcactgccagtcctataaaagcatacagtaatgtcccaggccttcacattcactcaccactcactgattcacccagaacaacttccagtcctgcaagctccattcatgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaatgctcagtccctggtatga

SEQ ID NO: 11441 - DNA, 586 bp, Artificial Sequence
  Synthetic polypeptide
gtaatgctggcataaaaaaacctactgcactgccagtcctataaaagcatacagtaatgtcccaggccttcacattcactcaccactcactgattcacccagaacaacttccagtcctgcaagctccattcatgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattgtactggcagaatctgtatgatatgctcagtccctggtatgatgagtttctag

SEQ ID NO: 11442 - DNA, 291 bp, Artificial Sequence
  Synthetic polypeptide
caaggagtaatcagagggtgagaacgtggagcctggtggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcc

SEQ ID NO: 11443 - DNA, 1175 bp, Artificial Sequence
  Synthetic polypeptide
caaggagtaatcagagggtgagaacgtggagcctggtggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatga

SEQ ID NO: 11444 - DNA, 215 bp, Artificial Sequence
  Synthetic polypeptide
caaggagtaatcagagggtgagaacgtggagcctggtggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgccc

SEQ ID NO: 11445 - DNA, 112 bp, Artificial Sequence; identical to SEQ ID NO: 7120
  Synthetic polypeptide

SEQ ID NO: 11446 - DNA, 682 bp, Artificial Sequence
  Synthetic polypeptide
ggccaggtgcagtggctgacgcctctaatccctgcactttgggaggccaaggtgggtggatcacctgaggttaggggtttgaaaccagcctggccaacatggtgaaaccccgtctctactaaaaacacaaaaattagctgggtgtggtggcatgcacctgtaatgccagctactcgggaggctgaagcaggagaatcacttgaacccaggaggcagaggttgcagtgagccaagattgcaccactgcactccactctgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacat

SEQ ID NO: 11447 - DNA, 1062 bp, Artificial Sequence
  Synthetic polypeptide
ggccaggtgcagtggctgacgcctctaatccctgcactttgggaggccaaggtgggtggatcacctgaggttaggggtttgaaaccagcctggccaacatggtgaaaccccgtctctactaaaaacacaaaaattagctgggtgtggtggcatgcacctgtaatgccagctactcgggaggctgaagcaggagaatcacttgaacccaggaggcagaggttgcagtgagccaagattgcaccactgcactccactctgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaa

SEQ ID NO: 11448 - DNA, 1040 bp, Artificial Sequence; identical to SEQ ID NO: 10948
  Synthetic polypeptide

SEQ ID NO: 11449 - DNA, 371 bp, Artificial Sequence; identical to SEQ ID NO: 10949
  Synthetic polypeptide

SEQ ID NO: 11450 - DNA, 568 bp, Artificial Sequence
  Synthetic polypeptide
caggcacaggggctcaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaa

SEQ ID NO: 11451 - DNA, 1222 bp, Artificial Sequence
  Synthetic polypeptide
tatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11452 - DNA, 529 bp, Artificial Sequence
  Synthetic polypeptide
tatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11453 - DNA, 565 bp, Artificial Sequence
  Synthetic polypeptide
cactgtaaagtgttagaagcaatactggccttggagttagaacacctacattctggttccattttcgtcactaaactattgtacgactttgttaagtcacttttcctctctggtctgcagaagaaaggcacggaactaggttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaa

SEQ ID NO: 11454 - DNA, 324 bp, Artificial Sequence
  Synthetic polypeptide
tgttggacaaataattcaaaatttccattagacaggaaaaataagttcaagagatatattgaacaacatggtgattatagttaataacaatatattatatacttgaacattgctaaaagatattttaagtgttctcaccacacacaaagggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctga

SEQ ID NO: 11455 - DNA, 371 bp, Artificial Sequence
  Synthetic polypeptide
caaggagtaatcagagggtgagaacgtggagcctggtggacaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcc

SEQ ID NO: 11456 - DNA, 1255 bp, Artificial Sequence
  Synthetic polypeptide
caaggagtaatcagagggtgagaacgtggagcctggtggacaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatga

SEQ ID NO: 11457 - DNA, 295 bp, Artificial Sequence
  Synthetic polypeptide
caaggagtaatcagagggtgagaacgtggagcctggtggacaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgccc

SEQ ID NO: 11458 - DNA, 1734 bp, Artificial Sequence
  Synthetic polypeptide
tggctgggctcgacggcccatgcctgtaatcccagcgctttgggaggccgaggcaggaggatggcttgagcccaggaggtcgaggctgcagtgagccatgatcatgacactgcactccaggctgataacagaggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactga

SEQ ID NO: 11459 - DNA, 2103 bp, Artificial Sequence
  Synthetic polypeptide
agcatatgcctttgtgcagggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccaaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttag

SEQ ID NO: 11460 - DNA, 462 bp, Artificial Sequence
  Synthetic polypeptide
agcatatgcctttgtgcagggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaaggtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtag

SEQ ID NO: 11461 - DNA, 1205 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11462 - DNA, 653 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11463 - DNA, 469 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11464 - DNA, 746 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11465 - DNA, 1241 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11466 - DNA, 1160 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11467 - DNA, 923 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11468 - DNA, 839 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11469 - DNA, 902 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11470 - DNA, 1581 bp, Artificial Sequence
  Synthetic polypeptide
gaggaagcatagagcagacaagaatctacttagggtggaggggccggctggtgaaggccactcagaactgcttcaaatgaagaggaccaggatgtttattttagggaagactcagaaggcccacaagtgtcatcttcagatgatggaaggactcttcatgtacgtgggagaagcactagaccttcctggagcctcagagcttgaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaa

SEQ ID NO: 11471 - DNA, 1704 bp, Artificial Sequence
  Synthetic polypeptide
gaggaagcatagagcagacaagaatctacttagggtggaggggccggctggtgaaggccactcagaactgcttcaaatgaagaggaccaggatgtttattttagggaagactcagaaggcccacaagtgtcatcttcagatgatggaaggactcttcatgtacgtgggagaagcactagaccttcctggagcctcagagcttgaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatga

SEQ ID NO: 11472 - DNA, 4259 bp, Artificial Sequence; identical to SEQ ID NO: 7592
  Synthetic polypeptide

SEQ ID NO: 11473 - DNA, 3476 bp, Artificial Sequence; identical to SEQ ID NO: 7593
  Synthetic polypeptide

SEQ ID NO: 11474 - DNA, 3497 bp, Artificial Sequence; identical to SEQ ID NO: 7594
  Synthetic polypeptide

SEQ ID NO: 11475 - DNA, 584 bp, Artificial Sequence
  Synthetic polypeptide
tgtgatggctaatattgagtgtcaaccaagtattgttcctgagtgtgtctctgagggtgttgccagtgtggctagaataaagcaggcagaagaaagtggaatgtggagacttaactgaattttctggccttcatctttctcccatgctgcatgcttcctgctctcgaacatcagactccaagttcttcagcctttggactcttggacttacacgaatggtttgccaggggctcttgggccttcagccacagactgaaggctgcactgtctgcttccctacttttgaggttttgggactcggactggctcccttgctccacagcttgcagacggcctattgtgggacttcatcttgtgatcgtatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaa

SEQ ID NO: 11476 - DNA, 769 bp, Artificial Sequence
  Synthetic polypeptide
gagtcttgggctcaactcctggctggatgtgtggtcttaggcagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatga

SEQ ID NO: 11477 - DNA, 68 bp, Artificial Sequence
  Synthetic polypeptide
gagtcttgggctcaactcctggctggatgtgtggtcttaggcagtttcaaaaaaaaagatttacatga

SEQ ID NO: 11478 - DNA, 842 bp, Artificial Sequence; identical to SEQ ID NO: 6534
  Synthetic polypeptide

SEQ ID NO: 11479 - DNA, 539 bp, Artificial Sequence
  Synthetic polypeptide
gacagggcgaggggagcgggtctgcggggcgcgggtgaagacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtga

SEQ ID NO: 11480 - DNA, 434 bp, Artificial Sequence
  Synthetic polypeptide
gacagggcgaggggagcgggtctgcggggcgcgggtgaagacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacggttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaa

SEQ ID NO: 11481 - DNA, 1579 bp, Artificial Sequence
  Synthetic polypeptide
caggggtctgcaacccgtgggccacagatgggtaccaatccatggcctgttaggaactgagcctcacagcaggaggcgggtggcaggcgagtgagctaagcttcatctatatttacagccgttcctcgtcactcgcatcactgcctgagctccgcctcctgtcagatcagcagtggcattagattctcatagaaacgtgaaccctactgtgaactgtgcatgcgtgggatctaggttgcacgctccttatgagaatttaatgtctgatgatctgtccctgtctcccattacccccagatgggaccatctagttgcaggaaaacaagctcagggctcccactgattctgcgtgatggctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcatcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctag

SEQ ID NO: 11482 - DNA, 500 bp, Artificial Sequence
  Synthetic polypeptide
gacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtga

SEQ ID NO: 11483 - DNA, 395 bp, Artificial Sequence
  Synthetic polypeptide
gacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacggttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaa

SEQ ID NO: 11484 - DNA, 715 bp, Artificial Sequence
  Synthetic polypeptide
caggatcctgagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaa

SEQ ID NO: 11485 - DNA, 627 bp, Artificial Sequence
  Synthetic polypeptide
caggatcctgagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaaatga

SEQ ID NO: 11486 - DNA, 266 bp, Artificial Sequence
  Synthetic polypeptide
cagtgtggcgtgaagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactga

SEQ ID NO: 11487 - DNA, 100 bp, Artificial Sequence; identical to SEQ ID NO: 6584
  Synthetic polypeptide

SEQ ID NO: 11488 - DNA, 617 bp, Artificial Sequence
  Synthetic polypeptide
gacagggcgaggggagcgggtctgcggggcgcgggtgaagacagggcgaggggagcgggtctgcggggcgcgggtgaagacagggcgaggggagcgggtcttgggggcgcgggtgaagacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtga

SEQ ID NO: 11489 - DNA, 512 bp, Artificial Sequence
  Synthetic polypeptide
gacagggcgaggggagcgggtctgcggggcgcgggtgaagacagggcgaggggagcgggtctgcggggcgcgggtgaagacagggcgaggggagcgggtcttgggggcgcgggtgaagacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacggttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaa

SEQ ID NO: 11490 - DNA, 406 bp, Artificial Sequence
  Synthetic polypeptide
caaggagtaatcagaggagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatga

SEQ ID NO: 11491 - DNA, 1579 bp, Artificial Sequence
  Synthetic polypeptide
caggggtctgcaacccgtgggccgcagatgggtaccaatccatggcctgttaggaactgagcctcacagcaggaggtgggtggcaggcgagtgagctaagcttcatctatatttacagccgttcctcgtcactcgcatcactgcctgagctccgcctcctgtcagatcagcagtggcattagattctcatagaaacgtgaaccctactgtgaactgtgcatgcgtgggatctaggttgcacgctccttatgagaatttaatgtctgatgatctgtccctgtctcccattacccccagatgggaccatctagttgcaggaaaacaagctcagggctcccactgattctgcgtgatggctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctag

SEQ ID NO: 11492 - DNA, 435 bp, Artificial Sequence
  Synthetic polypeptide
gatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctga

SEQ ID NO: 11493 - DNA, 351 bp, Artificial Sequence
  Synthetic polypeptide
gatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatga

SEQ ID NO: 11494 - DNA, 345 bp, Artificial Sequence
  Synthetic polypeptide
caaggagtaatcagagggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcc

SEQ ID NO: 11495 - DNA, 1229 bp, Artificial Sequence
  Synthetic polypeptide
caaggagtaatcagagggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatga

SEQ ID NO: 11496 - DNA, 269 bp, Artificial Sequence
  Synthetic polypeptide
caaggagtaatcagagggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgccc

SEQ ID NO: 11497 - DNA, 772 bp, Artificial Sequence
  Synthetic polypeptide
gaagcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtga

SEQ ID NO: 11498 - DNA, 347 bp, Artificial Sequence
  Synthetic polypeptide
ggtggctcacacctgtaatcccaacactttgggagactgaggcaggcagatcatctgaggtcaggagtttgagaccagcctggcccaatatgatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactag

SEQ ID NO: 11499 - DNA, 1267 bp, Artificial Sequence; identical to SEQ ID NO: 6631
  Synthetic polypeptide

SEQ ID NO: 11500 - DNA, 263 bp, Artificial Sequence; identical to SEQ ID NO: 6632
  Synthetic polypeptide

SEQ ID NO: 11501 - DNA, 502 bp, Artificial Sequence
  Synthetic polypeptide
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttga

SEQ ID NO: 11502 - DNA, 478 bp, Artificial Sequence
  Synthetic polypeptide
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtga

SEQ ID NO: 11503 - DNA, 372 bp, Artificial Sequence
  Synthetic polypeptide
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaa

SEQ ID NO: 11504 - DNA, 323 bp, Artificial Sequence
  Synthetic polypeptide
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagt

SEQ ID NO: 11505 - DNA, 222 bp, Artificial Sequence
  Synthetic polypeptide
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcg

SEQ ID NO: 11506 - DNA, 5350 bp, Artificial Sequence; identical to SEQ ID NO: 655
  Synthetic polypeptide

SEQ ID NO: 11507 - DNA, 387 bp, Artificial Sequence; identical to SEQ ID NO: 544
  Synthetic polypeptide

SEQ ID NO: 11508 - DNA, 540 bp, Artificial Sequence; identical to SEQ ID NO: 545
  Synthetic polypeptide

SEQ ID NO: 11509 - DNA, 303 bp, Artificial Sequence; identical to SEQ ID NO: 547
  Synthetic polypeptide

SEQ ID NO: 11510 - DNA, 1424 bp, Artificial Sequence
  Synthetic polypeptide
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtag

SEQ ID NO: 11511 - DNA, 1223 bp, Artificial Sequence
  Synthetic polypeptide
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtag

SEQ ID NO: 11512 - DNA, 444 bp, Artificial Sequence
  Synthetic polypeptide
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagcca

SEQ ID NO: 11513 - DNA, 398 bp, Artificial Sequence
  Synthetic polypeptide
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaat

SEQ ID NO: 11514 - DNA, 329 bp, Artificial Sequence
  Synthetic polypeptide
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagc

SEQ ID NO: 11515 - DNA, 193 bp, Artificial Sequence
  Synthetic polypeptide
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgt

SEQ ID NO: 11516 - DNA, 4908 bp, Artificial Sequence
  Synthetic polypeptide
ggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaaggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaattccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatag

SEQ ID NO: 11517 - DNA, 4611 bp, Artificial Sequence
  Synthetic polypeptide
ggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatag

SEQ ID NO: 11518 - DNA, 5142 bp, Artificial Sequence
  Synthetic polypeptide
ggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatag

SEQ ID NO: 11519 - DNA, 777 bp, Artificial Sequence
  Synthetic polypeptide
ggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggaggatctggaaacattggtcctgctttcccatgtcttgacaccccattccaagccagatgtcaaggagaagaaaggactttcaattaa

SEQ ID NO: 11520 - DNA, 1129 bp, Artificial Sequence
  Synthetic polypeptide
cagttgacccttgaacaacacagatttgaactccatgggcccacttatacatctattttttttccatagatatattgaaaatttttttgaagatttgtgacagtttgaaaaaacagatgaaccacatggcctagaaatatcaaaaacattaagaaaaagttagatatgtcgtgaacgcataaaatatatgtagatagatactagtttataaatatgcacaaatctgttataaagagttaaaatttatcaaagtttacaaatatttatagaccatacatggcaccatttacagttgagagaaatgtaaagaaatgtaaagatgcattaaatcataatggcataaaattaactctagtaatactgtactactgtaataattttgtggccacctgttgctattgcagtgaactcaagtgttacaagtattgagcataaaatgtcatgtgacactaatcatctttgtgtgagtggttcatctctttagtaaattgtgtatcatagtaaaaattgatctcttggaattctcttgtatttttttatcatgtttagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctga

SEQ ID NO: 11521 - DNA, 908 bp, Artificial Sequence
  Synthetic polypeptide
cagttgacccttgaacaacacagatttgaactccatgggcccacttatacatctattttttttccatagatatattgaaaatttttttgaagatttgtgacagtttgaaaaaacagatgaaccacatggcctagaaatatcaaaaacattaagaaaaagttagatatgtcgtgaacgcataaaatatatgtagatagatactagtttataaatatgcacaaatctgttataaagagttaaaatttatcaaagtttacaaatatttatagaccatacatggcaccatttacagttgagagaaatgtaaagaaatgtaaagatgcattaaatcataatggcataaaattaactctagtaatactgtactactgtaataattttgtggccacctgttgctattgcagtgaactcaagtgttacaagtattgagcataaaatgtcatgtgacactaatcatctttgtgtgagtggttcatctctttagtaaattgtgtatcatagtaaaaattgatctcttggaattctcttgtatttttttatcatgtttagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtga

SEQ ID NO: 11522 - DNA, 1204 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11523 - DNA, 652 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11524 - DNA, 468 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11525 - DNA, 745 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11526 - DNA, 1240 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11527 - DNA, 1159 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11528 - DNA, 922 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11529 - DNA, 838 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11530 - DNA, 901 bp, Artificial Sequence
  Synthetic polypeptide
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11531 - DNA, 191 bp, Artificial Sequence
  Synthetic polypeptide
agtgtggaccctggacaagaagcataggttgatatcacttgcaagtttattaccaatgccaactcaggcttcactcgagacctgctaattcagaatcagtatttgaataaggtcccaggggagagtacggtttccatgaatatacagaggtcaaaacagtcacagtgaaaatctctcagaagaactcataa

SEQ ID NO: 11532 - DNA, 1248 bp, Artificial Sequence
  Synthetic polypeptide
tatttactccccgatgtttaaaataggactttgaagcaagacaataagcttaaaagccaagctgtttagggtagagaattttctaaattccttttcttttttttcttaaaggctgaagaagactcagatttctgacacaatggtaacacctatcccttctgcctgtgactgccagggcttgctgtatgatgataagaagagaatgtgacacagaggaaggggaaaaagtccatccctctgatggtggctgcaggaatctgtcgttcagatgagcatgtggttagtggcaacctggtgaccccccttcctgtgattttaggccatgaggcagccggcatcgtggaaagtgtttgagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtcggcgtcagcaccttctcccagtacacagtggtggatgagaatgcagtggccaaaattgatgcagcctcgcccctggagaaagtctgcctcattggctgtggattttcgactggttatgggtctgcagtcaaagttgccaaggtcaccccagggtctacctgtgctgtgtttggcctgggaggggtcggcctatctgttgttatgggctgtaaagcagctggagcagccagaatcattgctgtggacatcaacaaggacaaatttgcaaaggctaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagtgtcattgtaggggtacctcctgattcccagaacctctcaataaaccctatgctgctactgactggacgcacgtggaaaggagctatttttggaggctttaagagtaaagaatctgtccccaaacttgtggctgactttatggctaagaagttttcactggatgcattaataacaaatattttaccttttgaaaaaataaatgaaggatttgacctgcttcgctctggaaagagtatccgtaccgtcctgacgttttga

SEQ ID NO: 11533 - DNA, 3050 bp, Artificial Sequence; identical to SEQ ID NO: 7595
  Synthetic polypeptide

SEQ ID NO: 11534 - DNA, 2267 bp, Artificial Sequence; identical to SEQ ID NO: 7596
  Synthetic polypeptide

SEQ ID NO: 11535 - DNA, 2288 bp, Artificial Sequence; identical to SEQ ID NO: 7597
  Synthetic polypeptide

SEQ ID NO: 11536 - DNA, 974 bp, Artificial Sequence
  Synthetic polypeptide
caaaaagcttggattctgtcctagtgcttttgactccgttttggtgactctaagcaagttgtgttactctctccgtgctttgatttcttcagtggtaaaggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctga

SEQ ID NO: 11537 - DNA, 622 bp, Artificial Sequence
  Synthetic polypeptide
caaaaagcttggattctgtcctagtgcttttgactccgttttggtgactctaagcaagttgtgttactctctccgtgctttgatttcttcagtggtaaaggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaata

SEQ ID NO: 11538 - DNA, 902 bp, Artificial Sequence
  Synthetic polypeptide
agcctacagattcagagtgtgcgttccagagccaggctctccagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaa

SEQ ID NO: 11539 - DNA, 333 bp, Artificial Sequence; identical to SEQ ID NO: 6583
  Synthetic polypeptide

SEQ ID NO: 11540 - DNA, 1392 bp, Artificial Sequence; identical to SEQ ID NO: 806
  Synthetic polypeptide

SEQ ID NO: 11541 - DNA, 1191 bp, Artificial Sequence; identical to SEQ ID NO: 807
  Synthetic polypeptide

SEQ ID NO: 11542 - DNA, 412 bp, Artificial Sequence; identical to SEQ ID NO: 809
  Synthetic polypeptide

SEQ ID NO: 11543 - DNA, 366 bp, Artificial Sequence; identical to SEQ ID NO: 810
  Synthetic polypeptide

SEQ ID NO: 11544 - DNA, 297 bp, Artificial Sequence; identical to SEQ ID NO: 811
  Synthetic polypeptide

SEQ ID NO: 11545 - DNA, 161 bp, Artificial Sequence; identical to SEQ ID NO: 812
  Synthetic polypeptide

SEQ ID NO: 11546 - DNA, 1460 bp, Artificial Sequence
  Synthetic polypeptide
tgcctgtcagaatgcatcctggaataggaccagaatcttccatttaccgcctctatggccaccacccatcatcacctgtctggatctgtgcagtcacccctgccctggcctccctccctcgttccctagagcagccagaggtcactgtgaacacccaaactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctga

SEQ ID NO: 11547 - DNA, 1030 bp, Artificial Sequence
  Synthetic polypeptide
tgcctgtcagaatgcatcctggaataggaccagaatcttccatttaccgcctctatggccaccacccatcatcacctgtctggatctgtgcagtcacccctgccctggcctccctccctcgttccctagagcagccagaggtcactgtgaacacccaaactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacac

SEQ ID NO: 11548 - DNA, 382 bp, Artificial Sequence; identical to SEQ ID NO: 434
  Synthetic polypeptide

SEQ ID NO: 11549 - DNA, 1148 bp, Artificial Sequence; identical to SEQ ID NO: 436
  Synthetic polypeptide

SEQ ID NO: 11550 - DNA, 871 bp, Artificial Sequence; identical to SEQ ID NO: 437
  Synthetic polypeptide

SEQ ID NO: 11551 - DNA, 421 bp, Artificial Sequence; identical to SEQ ID NO: 441
  Synthetic polypeptide

SEQ ID NO: 11552 - DNA, 638 bp, Artificial Sequence; identical to SEQ ID NO: 442
  Synthetic polypeptide

SEQ ID NO: 11553 - DNA, 337 bp, Artificial Sequence; identical to SEQ ID NO: 443
  Synthetic polypeptide

SEQ ID NO: 11554 - DNA, 1086 bp, Artificial Sequence; identical to SEQ ID NO: 444
  Synthetic polypeptide

SEQ ID NO: 11555 - DNA, 564 bp, Artificial Sequence; identical to SEQ ID NO: 445
  Synthetic polypeptide

SEQ ID NO: 11556 - DNA, 987 bp, Artificial Sequence; identical to SEQ ID NO: 446
  Synthetic polypeptide

SEQ ID NO: 11557 - DNA, 1052 bp, Artificial Sequence; identical to SEQ ID NO: 447
  Synthetic polypeptide

SEQ ID NO: 11558 - DNA, 1118 bp, Artificial Sequence; identical to SEQ ID NO: 448
  Synthetic polypeptide

SEQ ID NO: 11559 - DNA, 3021 bp, Artificial Sequence; identical to SEQ ID NO: 449
  Synthetic polypeptide

SEQ ID NO: 11560 - DNA, 3075 bp, Artificial Sequence; identical to SEQ ID NO: 450
  Synthetic polypeptide

SEQ ID NO: 11561 - DNA, 1143 bp, Artificial Sequence; identical to SEQ ID NO: 451
  Synthetic polypeptide

SEQ ID NO: 11562 - DNA, 347 bp, Artificial Sequence; identical to SEQ ID NO: 452
  Synthetic polypeptide

SEQ ID NO: 11563 - DNA, 148 bp, Artificial Sequence; identical to SEQ ID NO: 454
  Synthetic polypeptide

SEQ ID NO: 11564 - DNA, 594 bp, Artificial Sequence; identical to SEQ ID NO: 455
  Synthetic polypeptide

SEQ ID NO: 11565 - DNA, 1031 bp, Artificial Sequence; identical to SEQ ID NO: 456
  Synthetic polypeptide

SEQ ID NO: 11566 - DNA, 1267 bp, Artificial Sequence; identical to SEQ ID NO: 463
  Synthetic polypeptide

SEQ ID NO: 11567 - DNA, 7329 bp, Artificial Sequence; identical to SEQ ID NO: 464
  Synthetic polypeptide

SEQ ID NO: 11568 - DNA, 7320 bp, Artificial Sequence; identical to SEQ ID NO: 465
  Synthetic polypeptide

SEQ ID NO: 11569 - DNA, 201 bp, Artificial Sequence; identical to SEQ ID NO: 466
  Synthetic polypeptide

SEQ ID NO: 11570 - DNA, 165 bp, Artificial Sequence; identical to SEQ ID NO: 467
  Synthetic polypeptide

SEQ ID NO: 11571 - DNA, 129 bp, Artificial Sequence; identical to SEQ ID NO: 468
  Synthetic polypeptide

SEQ ID NO: 11572 - DNA, 201 bp, Artificial Sequence; identical to SEQ ID NO: 469
  Synthetic polypeptide

SEQ ID NO: 11573 - DNA, 270 bp, Artificial Sequence; identical to SEQ ID NO: 470
  Synthetic polypeptide

SEQ ID NO: 11574 - DNA, 1104 bp, Artificial Sequence; identical to SEQ ID NO: 472
  Synthetic polypeptide

SEQ ID NO: 11575 - DNA, 7356 bp, Artificial Sequence; identical to SEQ ID NO: 473
  Synthetic polypeptide

SEQ ID NO: 11576 - DNA, 246 bp, Artificial Sequence; identical to SEQ ID NO: 474
  Synthetic polypeptide

SEQ ID NO: 11577 - DNA, 1201 bp, Artificial Sequence; identical to SEQ ID NO: 475
  Synthetic polypeptide

SEQ ID NO: 11578 - DNA, 247 bp, Artificial Sequence; identical to SEQ ID NO: 476
  Synthetic polypeptide

SEQ ID NO: 11579 - DNA, 874 bp, Artificial Sequence; identical to SEQ ID NO: 477
  Synthetic polypeptide

SEQ ID NO: 11580 - DNA, 364 bp, Artificial Sequence; identical to SEQ ID NO: 478
  Synthetic polypeptide

SEQ ID NO: 11581 - DNA, 424 bp, Artificial Sequence; identical to SEQ ID NO: 479
  Synthetic polypeptide

SEQ ID NO: 11582 - DNA, 163 bp, Artificial Sequence; identical to SEQ ID NO: 480
  Synthetic polypeptide

SEQ ID NO: 11583 - DNA, 104 bp, Artificial Sequence; identical to SEQ ID NO: 481
  Synthetic polypeptide

SEQ ID NO: 11584 - DNA, 769 bp, Artificial Sequence; identical to SEQ ID NO: 6486
  Synthetic polypeptide

SEQ ID NO: 11585 - DNA, 721 bp, Artificial Sequence; identical to SEQ ID NO: 482
  Synthetic polypeptide

SEQ ID NO: 11586 - DNA, 522 bp, Artificial Sequence; identical to SEQ ID NO: 484
  Synthetic polypeptide

SEQ ID NO: 11587 - DNA, 299 bp, Artificial Sequence; identical to SEQ ID NO: 485
  Synthetic polypeptide

SEQ ID NO: 11588 - DNA, 213 bp, Artificial Sequence; identical to SEQ ID NO: 7877
  Synthetic polypeptide

SEQ ID NO: 11589 - DNA, 239 bp, Artificial Sequence; identical to SEQ ID NO: 487
  Synthetic polypeptide

SEQ ID NO: 11590 - DNA, 373 bp, Artificial Sequence
  Synthetic polypeptide
ggccagttgcagtggctgacacctgtccccagtactttgggaggccgaggagggagaatcacttgagcccagcggttcgagaccagctctgtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactga

SEQ ID NO: 11591 - DNA, 226 bp, Artificial Sequence
  Synthetic polypeptide
ggccagttgcagtggctgacacctgtccccagtactttgggaggccgaggagggagaatcacttgagcccagcggttcgagaccagctctgtgggtaattccagaattgattggccataccattgtcactgtattactgctcatgtcattgcactggttcatcttccttctcaacttacctgttgccacttggaatatatatcgtggtagcaactgcccttgctaa

SEQ ID NO: 11592 - DNA, 232 bp, Artificial Sequence
  Synthetic polypeptide
ggccagttgcagtggctgacacctgtccccagtactttgggaggccgaggagggagaatcacttgagcccagcggttcgagaccagctctgtgggtaattccagaattgattggccataccattgtcactgtattactgctcatgtcattgcactggttcatcttccttctcaacttacctgttgccacttggaatatatatcgtatgatcttagctttgataaatgactga

SEQ ID NO: 11593 - DNA, 367 bp, Artificial Sequence
  Synthetic polypeptide
ggccagttgcagtggctgacacctgtccccagtactttgggaggccgaggagggagaatcacttgagcccagcggttcgagaccagctctgtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaa

SEQ ID NO: 11594 - DNA, 1481 bp, Artificial Sequence
  Synthetic polypeptide
ctggctctgccattttgtaactcagtgagtcacttcatctctctgcttcagtttccctatcgcccatggcgctgcatggcttacatgagataatattcgcagtgcacttagatcagtgcctggcacacggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtga

SEQ ID NO: 11595 - DNA, 1658 bp, Artificial Sequence
  Synthetic polypeptide
ctggctctgccattttgtaactcagtgagtcacttcatctctctgcttcagtttccctatcgcccatggcgctgcatggcttacatgagataatattcgcagtgcacttagatcagtgcctggcacacggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccaaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtga

SEQ ID NO: 11596 - DNA, 508 bp, Artificial Sequence
  Synthetic polypeptide
ctgcccattccccaggactgttctcacatgtcacctgctcctcaaactttccttagaccctcacccagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaa

SEQ ID NO: 11597 - DNA, 750 bp, Artificial Sequence; identical to SEQ ID NO: 489
  Synthetic polypeptide

SEQ ID NO: 11598 - DNA, 38 bp, Artificial Sequence; identical to SEQ ID NO: 491
  Synthetic polypeptide

SEQ ID NO: 11599 - DNA, 249 bp, Artificial Sequence; identical to SEQ ID NO: 492
  Synthetic polypeptide

SEQ ID NO: 11600 - DNA, 503 bp, Artificial Sequence; identical to SEQ ID NO: 493
  Synthetic polypeptide

SEQ ID NO: 11601 - DNA, 476 bp, Artificial Sequence; identical to SEQ ID NO: 495
  Synthetic polypeptide

SEQ ID NO: 11602 - DNA, 539 bp, Artificial Sequence; identical to SEQ ID NO: 496
  Synthetic polypeptide

SEQ ID NO: 11603 - DNA, 566 bp, Artificial Sequence; identical to SEQ ID NO: 500
  Synthetic polypeptide

SEQ ID NO: 11604 - DNA, 1523 bp, Artificial Sequence; identical to SEQ ID NO: 501
  Synthetic polypeptide

SEQ ID NO: 11605 - DNA, 1544 bp, Artificial Sequence; identical to SEQ ID NO: 502
  Synthetic polypeptide

SEQ ID NO: 11606 - DNA, 1493 bp, Artificial Sequence; identical to SEQ ID NO: 504
  Synthetic polypeptide

SEQ ID NO: 11607 - DNA, 602 bp, Artificial Sequence; identical to SEQ ID NO: 505
  Synthetic polypeptide

SEQ ID NO: 11608 - DNA, 707 bp, Artificial Sequence; identical to SEQ ID NO: 506
  Synthetic polypeptide

SEQ ID NO: 11609 - DNA, 887 bp, Artificial Sequence; identical to SEQ ID NO: 507
  Synthetic polypeptide

SEQ ID NO: 11610 - DNA, 698 bp, Artificial Sequence; identical to SEQ ID NO: 508
  Synthetic polypeptide

SEQ ID NO: 11611 - DNA, 1477 bp, Artificial Sequence; identical to SEQ ID NO: 509
  Synthetic polypeptide

SEQ ID NO: 11612 - DNA, 1369 bp, Artificial Sequence; identical to SEQ ID NO: 510
  Synthetic polypeptide

SEQ ID NO: 11613 - DNA, 709 bp, Artificial Sequence; identical to SEQ ID NO: 511
  Synthetic polypeptide

SEQ ID NO: 11614 - DNA, 2850 bp, Artificial Sequence; identical to SEQ ID NO: 512
  Synthetic polypeptide

SEQ ID NO: 11615 - DNA, 477 bp, Artificial Sequence; identical to SEQ ID NO: 513
  Synthetic polypeptide

SEQ ID NO: 11616 - DNA, 2158 bp, Artificial Sequence; identical to SEQ ID NO: 514
  Synthetic polypeptide

SEQ ID NO: 11617 - DNA, 124 bp, Artificial Sequence; identical to SEQ ID NO: 515
  Synthetic polypeptide

SEQ ID NO: 11618 - DNA, 166 bp, Artificial Sequence; identical to SEQ ID NO: 516
  Synthetic polypeptide

SEQ ID NO: 11619 - DNA, 1776 bp, Artificial Sequence; identical to SEQ ID NO: 517
  Synthetic polypeptide

SEQ ID NO: 11620 - DNA, 319 bp, Artificial Sequence; identical to SEQ ID NO: 520
  Synthetic polypeptide

SEQ ID NO: 11621 - DNA, 372 bp, Artificial Sequence; identical to SEQ ID NO: 521
  Synthetic polypeptide

SEQ ID NO: 11622 - DNA, 2056 bp, Artificial Sequence; identical to SEQ ID NO: 522
  Synthetic polypeptide

SEQ ID NO: 11623 - DNA, 2098 bp, Artificial Sequence; identical to SEQ ID NO: 523
  Synthetic polypeptide

SEQ ID NO: 11624 - DNA, 463 bp, Artificial Sequence; identical to SEQ ID NO: 524
  Synthetic polypeptide

SEQ ID NO: 11625 - DNA, 1211 bp, Artificial Sequence; identical to SEQ ID NO: 526
  Synthetic polypeptide

SEQ ID NO: 11626 - DNA, 1133 bp, Artificial Sequence; identical to SEQ ID NO: 527
  Synthetic polypeptide

SEQ ID NO: 11627 - DNA, 841 bp, Artificial Sequence; identical to SEQ ID NO: 529
  Synthetic polypeptide

SEQ ID NO: 11628 - DNA, 659 bp, Artificial Sequence; identical to SEQ ID NO: 530
  Synthetic polypeptide

SEQ ID NO: 11629 - DNA, 1636 bp, Artificial Sequence; identical to SEQ ID NO: 531
  Synthetic polypeptide

SEQ ID NO: 11630 - DNA, 1328 bp, Artificial Sequence; identical to SEQ ID NO: 532
  Synthetic polypeptide

SEQ ID NO: 11631 - DNA, 334 bp, Artificial Sequence; identical to SEQ ID NO: 533
  Synthetic polypeptide

SEQ ID NO: 11632 - DNA, 1516 bp, Artificial Sequence; identical to SEQ ID NO: 534
  Synthetic polypeptide

SEQ ID NO: 11633 - DNA, 591 bp, Artificial Sequence; identical to SEQ ID NO: 539
  Synthetic polypeptide

SEQ ID NO: 11634 - DNA, 482 bp, Artificial Sequence; identical to SEQ ID NO: 540
  Synthetic polypeptide

SEQ ID NO: 11635 - DNA, 444 bp, Artificial Sequence; identical to SEQ ID NO: 541
  Synthetic polypeptide

SEQ ID NO: 11636 - DNA, 245 bp, Artificial Sequence; identical to SEQ ID NO: 542
  Synthetic polypeptide

SEQ ID NO: 11637 - DNA, 38 bp, Artificial Sequence; identical to SEQ ID NO: 543
  Synthetic polypeptide

SEQ ID NO: 11638 - DNA, 367 bp, Artificial Sequence; identical to SEQ ID NO: 548
  Synthetic polypeptide

SEQ ID NO: 11639 - DNA, 387 bp, Artificial Sequence; identical to SEQ ID NO: 544
  Synthetic polypeptide

SEQ ID NO: 11640 - DNA, 540 bp, Artificial Sequence; identical to SEQ ID NO: 545
  Synthetic polypeptide

SEQ ID NO: 11641 - DNA, 303 bp, Artificial Sequence; identical to SEQ ID NO: 547
  Synthetic polypeptide

SEQ ID NO: 11642 - DNA, 1331 bp, Artificial Sequence; identical to SEQ ID NO: 550
  Synthetic polypeptide

SEQ ID NO: 11643 - DNA, 1028 bp, Artificial Sequence; identical to SEQ ID NO: 551
  Synthetic polypeptide

SEQ ID NO: 11644 - DNA, 1295 bp, Artificial Sequence; identical to SEQ ID NO: 553
  Synthetic polypeptide

SEQ ID NO: 11645 - DNA, 1322 bp, Artificial Sequence; identical to SEQ ID NO: 554
  Synthetic polypeptide

SEQ ID NO: 11646 - DNA, 1013 bp, Artificial Sequence; identical to SEQ ID NO: 555
  Synthetic polypeptide

SEQ ID NO: 11647 - DNA, 7501 bp, Artificial Sequence; identical to SEQ ID NO: 557
  Synthetic polypeptide

SEQ ID NO: 11648 - DNA, 7492 bp, Artificial Sequence; identical to SEQ ID NO: 558
  Synthetic polypeptide

SEQ ID NO: 11649 - DNA, 373 bp, Artificial Sequence; identical to SEQ ID NO: 559
  Synthetic polypeptide

SEQ ID NO: 11650 - DNA, 337 bp, Artificial Sequence; identical to SEQ ID NO: 560
  Synthetic polypeptide

SEQ ID NO: 11651 - DNA, 301 bp, Artificial Sequence; identical to SEQ ID NO: 561
  Synthetic polypeptide

SEQ ID NO: 11652 - DNA, 373 bp, Artificial Sequence; identical to SEQ ID NO: 562
  Synthetic polypeptide

SEQ ID NO: 11653 - DNA, 442 bp, Artificial Sequence; identical to SEQ ID NO: 563
  Synthetic polypeptide

SEQ ID NO: 11654 - DNA, 1276 bp, Artificial Sequence; identical to SEQ ID NO: 565
  Synthetic polypeptide

SEQ ID NO: 11655 - DNA, 7528 bp, Artificial Sequence; identical to SEQ ID NO: 566
  Synthetic polypeptide

SEQ ID NO: 11656 - DNA, 418 bp, Artificial Sequence; identical to SEQ ID NO: 567
  Synthetic polypeptide

SEQ ID NO: 11657 - DNA, 1775 bp, Artificial Sequence; identical to SEQ ID NO: 568
  Synthetic polypeptide

SEQ ID NO: 11658 - DNA, 427 bp, Artificial Sequence; identical to SEQ ID NO: 573
  Synthetic polypeptide

SEQ ID NO: 11659 - DNA, 898 bp, Artificial Sequence; identical to SEQ ID NO: 569
  Synthetic polypeptide

SEQ ID NO: 11660 - DNA, 961 bp, Artificial Sequence; identical to SEQ ID NO: 570
  Synthetic polypeptide

SEQ ID NO: 11661 - DNA, 818 bp, Artificial Sequence; identical to SEQ ID NO: 572
  Synthetic polypeptide

SEQ ID NO: 11662 - DNA, 7177 bp, Artificial Sequence; identical to SEQ ID NO: 574
  Synthetic polypeptide

SEQ ID NO: 11663 - DNA, 7195 bp, Artificial Sequence; identical to SEQ ID NO: 575
  Synthetic polypeptide

SEQ ID NO: 11664 - DNA, 1407 bp, Artificial Sequence; identical to SEQ ID NO: 579
  Synthetic polypeptide

SEQ ID NO: 11665 - DNA, 1084 bp, Artificial Sequence; identical to SEQ ID NO: 580
  Synthetic polypeptide

SEQ ID NO: 11666 - DNA, 1815 bp, Artificial Sequence; identical to SEQ ID NO: 581
  Synthetic polypeptide

SEQ ID NO: 11667 - DNA, 2471 bp, Artificial Sequence; identical to SEQ ID NO: 576
  Synthetic polypeptide

SEQ ID NO: 11668 - DNA, 858 bp, Artificial Sequence; identical to SEQ ID NO: 582
  Synthetic polypeptide

SEQ ID NO: 11669 - DNA, 921 bp, Artificial Sequence; identical to SEQ ID NO: 583
  Synthetic polypeptide

SEQ ID NO: 11670 - DNA, 778 bp, Artificial Sequence; identical to SEQ ID NO: 585
  Synthetic polypeptide

SEQ ID NO: 11671 - DNA, 2534 bp, Artificial Sequence; identical to SEQ ID NO: 586
  Synthetic polypeptide

SEQ ID NO: 11672 - DNA, 463 bp, Artificial Sequence; identical to SEQ ID NO: 588
  Synthetic polypeptide

SEQ ID NO: 11673 - DNA, 1022 bp, Artificial Sequence; identical to SEQ ID NO: 590
  Synthetic polypeptide

SEQ ID NO: 11674 - DNA, 347 bp, Artificial Sequence; identical to SEQ ID NO: 591
  Synthetic polypeptide

SEQ ID NO: 11675 - DNA, 1109 bp, Artificial Sequence; identical to SEQ ID NO: 592
  Synthetic polypeptide

SEQ ID NO: 11676 - DNA, 269 bp, Artificial Sequence; identical to SEQ ID NO: 600
  Synthetic polypeptide

SEQ ID NO: 11677 - DNA, 85 bp, Artificial Sequence; identical to SEQ ID NO: 601
  Synthetic polypeptide

SEQ ID NO: 11678 - DNA, 414 bp, Artificial Sequence; identical to SEQ ID NO: 602
  Synthetic polypeptide

SEQ ID NO: 11679 - DNA, 434 bp, Artificial Sequence; identical to SEQ ID NO: 603
  Synthetic polypeptide

SEQ ID NO: 11680 - DNA, 861 bp, Artificial Sequence; identical to SEQ ID NO: 604
  Synthetic polypeptide

SEQ ID NO: 11681 - DNA, 763 bp, Artificial Sequence; identical to SEQ ID NO: 606
  Synthetic polypeptide

SEQ ID NO: 11682 - DNA, 56 bp, Artificial Sequence; identical to SEQ ID NO: 605
  Synthetic polypeptide

SEQ ID NO: 11683 - DNA, 501 bp, Artificial Sequence; identical to SEQ ID NO: 609
  Synthetic polypeptide

SEQ ID NO: 11684 - DNA, 1023 bp, Artificial Sequence; identical to SEQ ID NO: 611
  Synthetic polypeptide

SEQ ID NO: 11685 - DNA, 895 bp, Artificial Sequence; identical to SEQ ID NO: 613
  Synthetic polypeptide

SEQ ID NO: 11686 - DNA, 247 bp, Artificial Sequence; identical to SEQ ID NO: 614
  Synthetic polypeptide

SEQ ID NO: 11687 - DNA, 551 bp, Artificial Sequence; identical to SEQ ID NO: 615
  Synthetic polypeptide

SEQ ID NO: 11688 - DNA, 1269 bp, Artificial Sequence; identical to SEQ ID NO: 616
  Synthetic polypeptide

SEQ ID NO: 11689 - DNA, 1134 bp, Artificial Sequence; identical to SEQ ID NO: 617
  Synthetic polypeptide

SEQ ID NO: 11690 - DNA, 501 bp, Artificial Sequence; identical to SEQ ID NO: 618
  Synthetic polypeptide

SEQ ID NO: 11691 - DNA, 1321 bp, Artificial Sequence; identical to SEQ ID NO: 619
  Synthetic polypeptide

SEQ ID NO: 11692 - DNA, 1197 bp, Artificial Sequence; identical to SEQ ID NO: 620
  Synthetic polypeptide

SEQ ID NO: 11693 - DNA, 1203 bp, Artificial Sequence; identical to SEQ ID NO: 621
  Synthetic polypeptide

SEQ ID NO: 11694 - DNA, 1131 bp, Artificial Sequence; identical to SEQ ID NO: 622
  Synthetic polypeptide

SEQ ID NO: 11695 - DNA, 642 bp, Artificial Sequence; identical to SEQ ID NO: 623
  Synthetic polypeptide

SEQ ID NO: 11696 - DNA, 829 bp, Artificial Sequence; identical to SEQ ID NO: 624
  Synthetic polypeptide

SEQ ID NO: 11697 - DNA, 641 bp, Artificial Sequence; identical to SEQ ID NO: 638
  Synthetic polypeptide

SEQ ID NO: 11698 - DNA, 1257 bp, Artificial Sequence; identical to SEQ ID NO: 625
  Synthetic polypeptide

SEQ ID NO: 11699 - DNA, 1215 bp, Artificial Sequence; identical to SEQ ID NO: 626
  Synthetic polypeptide

SEQ ID NO: 11700 - DNA, 507 bp, Artificial Sequence; identical to SEQ ID NO: 628
  Synthetic polypeptide

SEQ ID NO: 11701 - DNA, 313 bp, Artificial Sequence; identical to SEQ ID NO: 629
  Synthetic polypeptide

SEQ ID NO: 11702 - DNA, 291 bp, Artificial Sequence; identical to SEQ ID NO: 630
  Synthetic polypeptide

SEQ ID NO: 11703 - DNA, 1046 bp, Artificial Sequence; identical to SEQ ID NO: 631
  Synthetic polypeptide

SEQ ID NO: 11704 - DNA, 968 bp, Artificial Sequence; identical to SEQ ID NO: 632
  Synthetic polypeptide

SEQ ID NO: 11705 - DNA, 676 bp, Artificial Sequence; identical to SEQ ID NO: 634
  Synthetic polypeptide

SEQ ID NO: 11706 - DNA, 494 bp, Artificial Sequence; identical to SEQ ID NO: 635
  Synthetic polypeptide

SEQ ID NO: 11707 - DNA, 920 bp, Artificial Sequence; identical to SEQ ID NO: 636
  Synthetic polypeptide

SEQ ID NO: 11708 - DNA, 2066 bp, Artificial Sequence; identical to SEQ ID NO: 639
  Synthetic polypeptide

SEQ ID NO: 11709 - DNA, 476 bp, Artificial Sequence; identical to SEQ ID NO: 646
  Synthetic polypeptide

SEQ ID NO: 11710 - DNA, 488 bp, Artificial Sequence; identical to SEQ ID NO: 647
  Synthetic polypeptide

SEQ ID NO: 11711 - DNA, 1284 bp, Artificial Sequence; identical to SEQ ID NO: 648
  Synthetic polypeptide

SEQ ID NO: 11712 - DNA, 1077 bp, Artificial Sequence; identical to SEQ ID NO: 649
  Synthetic polypeptide

SEQ ID NO: 11713 - DNA, 972 bp, Artificial Sequence; identical to SEQ ID NO: 650
  Synthetic polypeptide

SEQ ID NO: 11714 - DNA, 743 bp, Artificial Sequence; identical to SEQ ID NO: 651
  Synthetic polypeptide

SEQ ID NO: 11715 - DNA, 539 bp, Artificial Sequence; identical to SEQ ID NO: 653
  Synthetic polypeptide

SEQ ID NO: 11716 - DNA, 1218 bp, Artificial Sequence; identical to SEQ ID NO: 654
  Synthetic polypeptide

SEQ ID NO: 11717 - DNA, 5350 bp, Artificial Sequence; identical to SEQ ID NO: 655
  Synthetic polypeptide

SEQ ID NO: 11718 - DNA, 1397 bp, Artificial Sequence; identical to SEQ ID NO: 657
  Synthetic polypeptide

SEQ ID NO: 11719 - DNA, 701 bp, Artificial Sequence; identical to SEQ ID NO: 658
  Synthetic polypeptide

SEQ ID NO: 11720 - DNA, 611 bp, Artificial Sequence; identical to SEQ ID NO: 672
  Synthetic polypeptide

SEQ ID NO: 11721 - DNA, 464 bp, Artificial Sequence; identical to SEQ ID NO: 673
  Synthetic polypeptide

SEQ ID NO: 11722 - DNA, 470 bp, Artificial Sequence; identical to SEQ ID NO: 674
  Synthetic polypeptide

SEQ ID NO: 11723 - DNA, 605 bp, Artificial Sequence; identical to SEQ ID NO: 675
  Synthetic polypeptide

SEQ ID NO: 11724 - DNA, 861 bp, Artificial Sequence; identical to SEQ ID NO: 662
  Synthetic polypeptide

SEQ ID NO: 11725 - DNA, 2429 bp, Artificial Sequence; identical to SEQ ID NO: 664
  Synthetic polypeptide

SEQ ID NO: 11726 - DNA, 365 bp, Artificial Sequence; identical to SEQ ID NO: 665
  Synthetic polypeptide

SEQ ID NO: 11727 - DNA, 136 bp, Artificial Sequence; identical to SEQ ID NO: 666
  Synthetic polypeptide

SEQ ID NO: 11728 - DNA, 1014 bp, Artificial Sequence; identical to SEQ ID NO: 667
  Synthetic polypeptide

SEQ ID NO: 11729 - DNA, 1158 bp, Artificial Sequence; identical to SEQ ID NO: 668
  Synthetic polypeptide

SEQ ID NO: 11730 - DNA, 1125 bp, Artificial Sequence; identical to SEQ ID NO: 669
  Synthetic polypeptide

SEQ ID NO: 11731 - DNA, 1694 bp, Artificial Sequence; identical to SEQ ID NO: 670
  Synthetic polypeptide

SEQ ID NO: 11732 - DNA, 725 bp, Artificial Sequence; identical to SEQ ID NO: 671
  Synthetic polypeptide

SEQ ID NO: 11733 - DNA, 1234 bp, Artificial Sequence; identical to SEQ ID NO: 676
  Synthetic polypeptide

SEQ ID NO: 11734 - DNA, 586 bp, Artificial Sequence; identical to SEQ ID NO: 677
  Synthetic polypeptide

SEQ ID NO: 11735 - DNA, 890 bp, Artificial Sequence; identical to SEQ ID NO: 678
  Synthetic polypeptide

SEQ ID NO: 11736 - DNA, 380 bp, Artificial Sequence; identical to SEQ ID NO: 682
  Synthetic polypeptide

SEQ ID NO: 11737 - DNA, 422 bp, Artificial Sequence; identical to SEQ ID NO: 683
  Synthetic polypeptide

SEQ ID NO: 11738 - DNA, 271 bp, Artificial Sequence; identical to SEQ ID NO: 684
  Synthetic polypeptide

SEQ ID NO: 11739 - DNA, 197 bp, Artificial Sequence; identical to SEQ ID NO: 685
  Synthetic polypeptide

SEQ ID NO: 11740 - DNA, 524 bp, Artificial Sequence; identical to SEQ ID NO: 686
  Synthetic polypeptide

SEQ ID NO: 11741 - DNA, 1718 bp, Artificial Sequence; identical to SEQ ID NO: 695
  Synthetic polypeptide

SEQ ID NO: 11742 - DNA, 1769 bp, Artificial Sequence; identical to SEQ ID NO: 696
  Synthetic polypeptide

SEQ ID NO: 11743 - DNA, 1763 bp, Artificial Sequence; identical to SEQ ID NO: 697
  Synthetic polypeptide

SEQ ID NO: 11744 - DNA, 394 bp, Artificial Sequence; identical to SEQ ID NO: 701
  Synthetic polypeptide

SEQ ID NO: 11745 - DNA, 700 bp, Artificial Sequence; identical to SEQ ID NO: 702
  Synthetic polypeptide

SEQ ID NO: 11746 - DNA, 568 bp, Artificial Sequence; identical to SEQ ID NO: 703
  Synthetic polypeptide

SEQ ID NO: 11747 - DNA, 535 bp, Artificial Sequence; identical to SEQ ID NO: 704
  Synthetic polypeptide

SEQ ID NO: 11748 - DNA, 129 bp, Artificial Sequence; identical to SEQ ID NO: 705
  Synthetic polypeptide

SEQ ID NO: 11749 - DNA, 435 bp, Artificial Sequence; identical to SEQ ID NO: 706
  Synthetic polypeptide

SEQ ID NO: 11750 - DNA, 303 bp, Artificial Sequence; identical to SEQ ID NO: 707
  Synthetic polypeptide

SEQ ID NO: 11751 - DNA, 270 bp, Artificial Sequence; identical to SEQ ID NO: 708
  Synthetic polypeptide

SEQ ID NO: 11752 - DNA, 3055 bp, Artificial Sequence; identical to SEQ ID NO: 709
  Synthetic polypeptide

SEQ ID NO: 11753 - DNA, 3058 bp, Artificial Sequence; identical to SEQ ID NO: 710
  Synthetic polypeptide

SEQ ID NO: 11754 - DNA, 1680 bp, Artificial Sequence; identical to SEQ ID NO: 733
  Synthetic polypeptide

SEQ ID NO: 11755 - DNA, 1584 bp, Artificial Sequence; identical to SEQ ID NO: 734
  Synthetic polypeptide

SEQ ID NO: 11756 - DNA, 1494 bp, Artificial Sequence; identical to SEQ ID NO: 736
  Synthetic polypeptide

SEQ ID NO: 11757 - DNA, 1491 bp, Artificial Sequence; identical to SEQ ID NO: 737
  Synthetic polypeptide

SEQ ID NO: 11758 - DNA, 1482 bp, Artificial Sequence; identical to SEQ ID NO: 738
  Synthetic polypeptide

SEQ ID NO: 11759 - DNA, 1485 bp, Artificial Sequence; identical to SEQ ID NO: 739
  Synthetic polypeptide

SEQ ID NO: 11760 - DNA, 515 bp, Artificial Sequence; identical to SEQ ID NO: 679
  Synthetic polypeptide

SEQ ID NO: 11761 - DNA, 407 bp, Artificial Sequence; identical to SEQ ID NO: 680
  Synthetic polypeptide

SEQ ID NO: 11762 - DNA, 485 bp, Artificial Sequence; identical to SEQ ID NO: 681
  Synthetic polypeptide

SEQ ID NO: 11763 - DNA, 2194 bp, Artificial Sequence; identical to SEQ ID NO: 687
  Synthetic polypeptide

SEQ ID NO: 11764 - DNA, 362 bp, Artificial Sequence; identical to SEQ ID NO: 688
  Synthetic polypeptide

SEQ ID NO: 11765 - DNA, 781 bp, Artificial Sequence; identical to SEQ ID NO: 689
  Synthetic polypeptide

SEQ ID NO: 11766 - DNA, 844 bp, Artificial Sequence; identical to SEQ ID NO: 690
  Synthetic polypeptide

SEQ ID NO: 11767 - DNA, 701 bp, Artificial Sequence; identical to SEQ ID NO: 692
  Synthetic polypeptide

SEQ ID NO: 11768 - DNA, 812 bp, Artificial Sequence; identical to SEQ ID NO: 693
  Synthetic polypeptide

SEQ ID NO: 11769 - DNA, 752 bp, Artificial Sequence; identical to SEQ ID NO: 694
  Synthetic polypeptide

SEQ ID NO: 11770 - DNA, 970 bp, Artificial Sequence; identical to SEQ ID NO: 711
  Synthetic polypeptide

SEQ ID NO: 11771 - DNA, 1681 bp, Artificial Sequence; identical to SEQ ID NO: 714
  Synthetic polypeptide

SEQ ID NO: 11772 - DNA, 1543 bp, Artificial Sequence; identical to SEQ ID NO: 717
  Synthetic polypeptide

SEQ ID NO: 11773 - DNA, 258 bp, Artificial Sequence; identical to SEQ ID NO: 719
  Synthetic polypeptide

SEQ ID NO: 11774 - DNA, 1027 bp, Artificial Sequence; identical to SEQ ID NO: 720
  Synthetic polypeptide

SEQ ID NO: 11775 - DNA, 648 bp, Artificial Sequence; identical to SEQ ID NO: 721
  Synthetic polypeptide

SEQ ID NO: 11776 - DNA, 643 bp, Artificial Sequence; identical to SEQ ID NO: 722
  Synthetic polypeptide

SEQ ID NO: 11777 - DNA, 335 bp, Artificial Sequence; identical to SEQ ID NO: 723
  Synthetic polypeptide

SEQ ID NO: 11778 - DNA, 767 bp, Artificial Sequence; identical to SEQ ID NO: 724
  Synthetic polypeptide

SEQ ID NO: 11779 - DNA, 1211 bp, Artificial Sequence; identical to SEQ ID NO: 729
  Synthetic polypeptide

SEQ ID NO: 11780 - DNA, 806 bp, Artificial Sequence; identical to SEQ ID NO: 730
  Synthetic polypeptide

SEQ ID NO: 11781 - DNA, 1175 bp, Artificial Sequence; identical to SEQ ID NO: 731
  Synthetic polypeptide

SEQ ID NO: 11782 - DNA, 59 bp, Artificial Sequence; identical to SEQ ID NO: 742
  Synthetic polypeptide

SEQ ID NO: 11783 - DNA, 123 bp, Artificial Sequence; identical to SEQ ID NO: 743
  Synthetic polypeptide

SEQ ID NO: 11784 - DNA, 445 bp, Artificial Sequence; identical to SEQ ID NO: 744
  Synthetic polypeptide

SEQ ID NO: 11785 - DNA, 677 bp, Artificial Sequence; identical to SEQ ID NO: 747
  Synthetic polypeptide

SEQ ID NO: 11786 - DNA, 674 bp, Artificial Sequence; identical to SEQ ID NO: 748
  Synthetic polypeptide

SEQ ID NO: 11787 - DNA, 400 bp, Artificial Sequence; identical to SEQ ID NO: 749
  Synthetic polypeptide

SEQ ID NO: 11788 - DNA, 2301 bp, Artificial Sequence; identical to SEQ ID NO: 750
  Synthetic polypeptide

SEQ ID NO: 11789 - DNA, 2381 bp, Artificial Sequence; identical to SEQ ID NO: 751
  Synthetic polypeptide

SEQ ID NO: 11790 - DNA, 692 bp, Artificial Sequence; identical to SEQ ID NO: 752
  Synthetic polypeptide

SEQ ID NO: 11791 - DNA, 852 bp, Artificial Sequence; identical to SEQ ID NO: 753
  Synthetic polypeptide

SEQ ID NO: 11792 - DNA, 1036 bp, Artificial Sequence; identical to SEQ ID NO: 754
  Synthetic polypeptide

SEQ ID NO: 11793 - DNA, 204 bp, Artificial Sequence; identical to SEQ ID NO: 755
  Synthetic polypeptide

SEQ ID NO: 11794 - DNA, 564 bp, Artificial Sequence; identical to SEQ ID NO: 756
  Synthetic polypeptide

SEQ ID NO: 11795 - DNA, 597 bp, Artificial Sequence; identical to SEQ ID NO: 759
  Synthetic polypeptide

SEQ ID NO: 11796 - DNA, 654 bp, Artificial Sequence; identical to SEQ ID NO: 760
  Synthetic polypeptide

SEQ ID NO: 11797 - DNA, 318 bp, Artificial Sequence; identical to SEQ ID NO: 770
  Synthetic polypeptide

SEQ ID NO: 11798 - DNA, 1471 bp, Artificial Sequence; identical to SEQ ID NO: 771
  Synthetic polypeptide

SEQ ID NO: 11799 - DNA, 1366 bp, Artificial Sequence; identical to SEQ ID NO: 772
  Synthetic polypeptide

SEQ ID NO: 11800 - DNA, 1328 bp, Artificial Sequence; identical to SEQ ID NO: 783
  Synthetic polypeptide

SEQ ID NO: 11801 - DNA, 1325 bp, Artificial Sequence; identical to SEQ ID NO: 784
  Synthetic polypeptide

SEQ ID NO: 11802 - DNA, 541 bp, Artificial Sequence; identical to SEQ ID NO: 787
  Synthetic polypeptide

SEQ ID NO: 11803 - DNA, 1024 bp, Artificial Sequence; identical to SEQ ID NO: 794
  Synthetic polypeptide

SEQ ID NO: 11804 - DNA, 1279 bp, Artificial Sequence; identical to SEQ ID NO: 795
  Synthetic polypeptide

SEQ ID NO: 11805 - DNA, 590 bp, Artificial Sequence; identical to SEQ ID NO: 796
  Synthetic polypeptide

SEQ ID NO: 11806 - DNA, 1175 bp, Artificial Sequence; identical to SEQ ID NO: 761
  Synthetic polypeptide

SEQ ID NO: 11807 - DNA, 770 bp, Artificial Sequence; identical to SEQ ID NO: 762
  Synthetic polypeptide

SEQ ID NO: 11808 - DNA, 1139 bp, Artificial Sequence; identical to SEQ ID NO: 763
  Synthetic polypeptide

SEQ ID NO: 11809 - DNA, 1217 bp, Artificial Sequence; identical to SEQ ID NO: 765
  Synthetic polypeptide

SEQ ID NO: 11810 - DNA, 1139 bp, Artificial Sequence; identical to SEQ ID NO: 766
  Synthetic polypeptide

SEQ ID NO: 11811 - DNA, 847 bp, Artificial Sequence; identical to SEQ ID NO: 768
  Synthetic polypeptide

SEQ ID NO: 11812 - DNA, 665 bp, Artificial Sequence; identical to SEQ ID NO: 769
  Synthetic polypeptide

SEQ ID NO: 11813 - DNA, 299 bp, Artificial Sequence; identical to SEQ ID NO: 773
  Synthetic polypeptide

SEQ ID NO: 11814 - DNA, 503 bp, Artificial Sequence; identical to SEQ ID NO: 774
  Synthetic polypeptide

SEQ ID NO: 11815 - DNA, 317 bp, Artificial Sequence; identical to SEQ ID NO: 780
  Synthetic polypeptide

SEQ ID NO: 11816 - DNA, 344 bp, Artificial Sequence; identical to SEQ ID NO: 782
  Synthetic polypeptide

SEQ ID NO: 11817 - DNA, 1052 bp, Artificial Sequence; identical to SEQ ID NO: 789
  Synthetic polypeptide

SEQ ID NO: 11818 - DNA, 974 bp, Artificial Sequence; identical to SEQ ID NO: 790
  Synthetic polypeptide

SEQ ID NO: 11819 - DNA, 682 bp, Artificial Sequence; identical to SEQ ID NO: 792
  Synthetic polypeptide

SEQ ID NO: 11820 - DNA, 500 bp, Artificial Sequence; identical to SEQ ID NO: 793
  Synthetic polypeptide

SEQ ID NO: 11821 - DNA, 463 bp, Artificial Sequence; identical to SEQ ID NO: 803
  Synthetic polypeptide

SEQ ID NO: 11822 - DNA, 745 bp, Artificial Sequence; identical to SEQ ID NO: 804
  Synthetic polypeptide

SEQ ID NO: 11823 - DNA, 1392 bp, Artificial Sequence; identical to SEQ ID NO: 806
  Synthetic polypeptide

SEQ ID NO: 11824 - DNA, 1191 bp, Artificial Sequence; identical to SEQ ID NO: 807
  Synthetic polypeptide

SEQ ID NO: 11825 - DNA, 412 bp, Artificial Sequence; identical to SEQ ID NO: 809
  Synthetic polypeptide

SEQ ID NO: 11826 - DNA, 366 bp, Artificial Sequence; identical to SEQ ID NO: 810
  Synthetic polypeptide

SEQ ID NO: 11827 - DNA, 297 bp, Artificial Sequence; identical to SEQ ID NO: 811
  Synthetic polypeptide

SEQ ID NO: 11828 - DNA, 161 bp, Artificial Sequence; identical to SEQ ID NO: 812
  Synthetic polypeptide

SEQ ID NO: 11829 - DNA, 636 bp, Artificial Sequence; identical to SEQ ID NO: 817
  Synthetic polypeptide

SEQ ID NO: 11830 - DNA, 582 bp, Artificial Sequence; identical to SEQ ID NO: 819
  Synthetic polypeptide

SEQ ID NO: 11831 - DNA, 718 bp, Artificial Sequence; identical to SEQ ID NO: 821
  Synthetic polypeptide

SEQ ID NO: 11832 - DNA, 1913 bp, Artificial Sequence; identical to SEQ ID NO: 822
  Synthetic polypeptide

SEQ ID NO: 11833 - DNA, 1874 bp, Artificial Sequence; identical to SEQ ID NO: 824
  Synthetic polypeptide

SEQ ID NO: 11834 - DNA, 136 bp, Artificial Sequence; identical to SEQ ID NO: 830
  Synthetic polypeptide

SEQ ID NO: 11835 - DNA, 164 bp, Artificial Sequence; identical to SEQ ID NO: 831
  Synthetic polypeptide

SEQ ID NO: 11836 - DNA, 193 bp, Artificial Sequence; identical to SEQ ID NO: 834
  Synthetic polypeptide

SEQ ID NO: 11837 - DNA, 915 bp, Artificial Sequence; identical to SEQ ID NO: 835
  Synthetic polypeptide

SEQ ID NO: 11838 - DNA, 735 bp, Artificial Sequence; identical to SEQ ID NO: 836
  Synthetic polypeptide

SEQ ID NO: 11839 - DNA, 451 bp, Artificial Sequence; identical to SEQ ID NO: 837
  Synthetic polypeptide

SEQ ID NO: 11840 - DNA, 546 bp, Artificial Sequence; identical to SEQ ID NO: 840
  Synthetic polypeptide

SEQ ID NO: 11841 - DNA, 1557 bp, Artificial Sequence; identical to SEQ ID NO: 845
  Synthetic polypeptide

SEQ ID NO: 11842 - DNA, 1449 bp, Artificial Sequence; identical to SEQ ID NO: 846
  Synthetic polypeptide

SEQ ID NO: 11843 - DNA, 789 bp, Artificial Sequence; identical to SEQ ID NO: 847
  Synthetic polypeptide

SEQ ID NO: 11844 - DNA, 904 bp, Artificial Sequence; identical to SEQ ID NO: 848
  Synthetic polypeptide

SEQ ID NO: 11845 - DNA, 430 bp, Artificial Sequence; identical to SEQ ID NO: 849
  Synthetic polypeptide

SEQ ID NO: 11846 - DNA, 649 bp, Artificial Sequence; identical to SEQ ID NO: 853
  Synthetic polypeptide

SEQ ID NO: 11847 - DNA, 425 bp, Artificial Sequence; identical to SEQ ID NO: 855
  Synthetic polypeptide

SEQ ID NO: 11848 - DNA, 233 bp, Artificial Sequence; identical to SEQ ID NO: 856
  Synthetic polypeptide

SEQ ID NO: 11849 - DNA, 566 bp, Artificial Sequence; identical to SEQ ID NO: 869
  Synthetic polypeptide

SEQ ID NO: 11850 - DNA, 343 bp, Artificial Sequence; identical to SEQ ID NO: 891
  Synthetic polypeptide

SEQ ID NO: 11851 - DNA, 838 bp, Artificial Sequence; identical to SEQ ID NO: 893
  Synthetic polypeptide

SEQ ID NO: 11852 - DNA, 547 bp, Artificial Sequence; identical to SEQ ID NO: 894
  Synthetic polypeptide

SEQ ID NO: 11853 - DNA, 394 bp, Artificial Sequence; identical to SEQ ID NO: 897
  Synthetic polypeptide

SEQ ID NO: 11854 - DNA, 473 bp, Artificial Sequence; identical to SEQ ID NO: 903
  Synthetic polypeptide

SEQ ID NO: 11855 - DNA, 586 bp, Artificial Sequence; identical to SEQ ID NO: 904
  Synthetic polypeptide

SEQ ID NO: 11856 - DNA, 373 bp, Artificial Sequence; identical to SEQ ID NO: 896
  Synthetic polypeptide

SEQ ID NO: 11857 - DNA, 460 bp, Artificial Sequence; identical to SEQ ID NO: 813
  Synthetic polypeptide

SEQ ID NO: 11858 - DNA, 362 bp, Artificial Sequence; identical to SEQ ID NO: 827
  Synthetic polypeptide

SEQ ID NO: 11859 - DNA, 1583 bp, Artificial Sequence; identical to SEQ ID NO: 828
  Synthetic polypeptide

SEQ ID NO: 11860 - DNA, 1421 bp, Artificial Sequence; identical to SEQ ID NO: 829
  Synthetic polypeptide

SEQ ID NO: 11861 - DNA, 818 bp, Artificial Sequence; identical to SEQ ID NO: 841
  Synthetic polypeptide

SEQ ID NO: 11862 - DNA, 881 bp, Artificial Sequence; identical to SEQ ID NO: 842
  Synthetic polypeptide

SEQ ID NO: 11863 - DNA, 738 bp, Artificial Sequence; identical to SEQ ID NO: 844
  Synthetic polypeptide

SEQ ID NO: 11864 - DNA, 1595 bp, Artificial Sequence; identical to SEQ ID NO: 851
  Synthetic polypeptide

SEQ ID NO: 11865 - DNA, 1433 bp, Artificial Sequence; identical to SEQ ID NO: 852
  Synthetic polypeptide

SEQ ID NO: 11866 - DNA, 375 bp, Artificial Sequence; identical to SEQ ID NO: 860
  Synthetic polypeptide

SEQ ID NO: 11867 - DNA, 255 bp, Artificial Sequence; identical to SEQ ID NO: 862
  Synthetic polypeptide

SEQ ID NO: 11868 - DNA, 1389 bp, Artificial Sequence; identical to SEQ ID NO: 863
  Synthetic polypeptide

SEQ ID NO: 11869 - DNA, 2094 bp, Artificial Sequence; identical to SEQ ID NO: 865
  Synthetic polypeptide

SEQ ID NO: 11870 - DNA, 2067 bp, Artificial Sequence; identical to SEQ ID NO: 868
  Synthetic polypeptide

SEQ ID NO: 11871 - DNA, 1593 bp, Artificial Sequence; identical to SEQ ID NO: 870
  Synthetic polypeptide

SEQ ID NO: 11872 - DNA, 1431 bp, Artificial Sequence; identical to SEQ ID NO: 871
  Synthetic polypeptide

SEQ ID NO: 11873 - DNA, 1002 bp, Artificial Sequence; identical to SEQ ID NO: 872
  Synthetic polypeptide

SEQ ID NO: 11874 - DNA, 897 bp, Artificial Sequence; identical to SEQ ID NO: 873
  Synthetic polypeptide

SEQ ID NO: 11875 - DNA, 836 bp, Artificial Sequence; identical to SEQ ID NO: 874
  Synthetic polypeptide

SEQ ID NO: 11876 - DNA, 528 bp, Artificial Sequence; identical to SEQ ID NO: 875
  Synthetic polypeptide

SEQ ID NO: 11877 - DNA, 549 bp, Artificial Sequence; identical to SEQ ID NO: 876
  Synthetic polypeptide

SEQ ID NO: 11878 - DNA, 1795 bp, Artificial Sequence; identical to SEQ ID NO: 879
  Synthetic polypeptide

SEQ ID NO: 11879 - DNA, 1171 bp, Artificial Sequence; identical to SEQ ID NO: 880
  Synthetic polypeptide

SEQ ID NO: 11880 - DNA, 507 bp, Artificial Sequence; identical to SEQ ID NO: 881
  Synthetic polypeptide

SEQ ID NO: 11881 - DNA, 1194 bp, Artificial Sequence; identical to SEQ ID NO: 898
  Synthetic polypeptide

SEQ ID NO: 11882 - DNA, 1116 bp, Artificial Sequence; identical to SEQ ID NO: 899
  Synthetic polypeptide

SEQ ID NO: 11883 - DNA, 824 bp, Artificial Sequence; identical to SEQ ID NO: 901
  Synthetic polypeptide

SEQ ID NO: 11884 - DNA, 642 bp, Artificial Sequence; identical to SEQ ID NO: 902
  Synthetic polypeptide

SEQ ID NO: 11885 - DNA, 1737 bp, Artificial Sequence; identical to SEQ ID NO: 905
  Synthetic polypeptide

SEQ ID NO: 11886 - DNA, 284 bp, Artificial Sequence; identical to SEQ ID NO: 906
  Synthetic polypeptide

SEQ ID NO: 11887 - DNA, 856 bp, Artificial Sequence; identical to SEQ ID NO: 907
  Synthetic polypeptide

SEQ ID NO: 11888 - DNA, 802 bp, Artificial Sequence; identical to SEQ ID NO: 908
  Synthetic polypeptide

SEQ ID NO: 11889 - DNA, 561 bp, Artificial Sequence; identical to SEQ ID NO: 909
  Synthetic polypeptide

SEQ ID NO: 11890 - DNA, 582 bp, Artificial Sequence; identical to SEQ ID NO: 910
  Synthetic polypeptide

SEQ ID NO: 11891 - DNA, 163 bp, Artificial Sequence; identical to SEQ ID NO: 480
  Synthetic polypeptide

SEQ ID NO: 11892 - DNA, 104 bp, Artificial Sequence; identical to SEQ ID NO: 481
  Synthetic polypeptide

SEQ ID NO: 11893 - DNA, 1148 bp, Artificial Sequence; identical to SEQ ID NO: 436
  Synthetic polypeptide

SEQ ID NO: 11894 - DNA, 3021 bp, Artificial Sequence; identical to SEQ ID NO: 449
  Synthetic polypeptide

SEQ ID NO: 11895 - DNA, 3075 bp, Artificial Sequence; identical to SEQ ID NO: 450
  Synthetic polypeptide

SEQ ID NO: 11896 - DNA, 1143 bp, Artificial Sequence; identical to SEQ ID NO: 451
  Synthetic polypeptide

SEQ ID NO: 11897 - DNA, 382 bp, Artificial Sequence; identical to SEQ ID NO: 434
  Synthetic polypeptide

SEQ ID NO: 11898 - DNA, 252 bp, Artificial Sequence; identical to SEQ ID NO: 7309
  Synthetic polypeptide

SEQ ID NO: 11899 - DNA, 1629 bp, Artificial Sequence; identical to SEQ ID NO: 8070
  Synthetic polypeptide

SEQ ID NO: 11900 - DNA, 1500 bp, Artificial Sequence; identical to SEQ ID NO: 8071
  Synthetic polypeptide

SEQ ID NO: 11901 - DNA, 792 bp, Artificial Sequence; identical to SEQ ID NO: 6418
  Synthetic polypeptide

SEQ ID NO: 11902 - DNA, 369 bp, Artificial Sequence; identical to SEQ ID NO: 6419
  Synthetic polypeptide

SEQ ID NO: 11903 - DNA, 249 bp, Artificial Sequence; identical to SEQ ID NO: 6420
  Synthetic polypeptide

SEQ ID NO: 11904 - DNA, 369 bp, Artificial Sequence; identical to SEQ ID NO: 6421
  Synthetic polypeptide

SEQ ID NO: 11905 - DNA, 843 bp, Artificial Sequence; identical to SEQ ID NO: 6422
  Synthetic polypeptide

SEQ ID NO: 11906 - DNA, 853 bp, Artificial Sequence; identical to SEQ ID NO: 8074
  Synthetic polypeptide

SEQ ID NO: 11907 - DNA, 1331 bp, Artificial Sequence; identical to SEQ ID NO: 550
  Synthetic polypeptide

SEQ ID NO: 11908 - DNA, 1028 bp, Artificial Sequence; identical to SEQ ID NO: 551
  Synthetic polypeptide

SEQ ID NO: 11909 - DNA, 1295 bp, Artificial Sequence; identical to SEQ ID NO: 553
  Synthetic polypeptide

SEQ ID NO: 11910 - DNA, 1322 bp, Artificial Sequence; identical to SEQ ID NO: 554
  Synthetic polypeptide

SEQ ID NO: 11911 - DNA, 1013 bp, Artificial Sequence; identical to SEQ ID NO: 555
  Synthetic polypeptide

SEQ ID NO: 11912 - DNA, 2588 bp, Artificial Sequence; identical to SEQ ID NO: 6741
  Synthetic polypeptide

SEQ ID NO: 11913 - DNA, 1964 bp, Artificial Sequence; identical to SEQ ID NO: 6742
  Synthetic polypeptide

SEQ ID NO: 11914 - DNA, 871 bp, Artificial Sequence; identical to SEQ ID NO: 437
  Synthetic polypeptide

SEQ ID NO: 11915 - DNA, 421 bp, Artificial Sequence; identical to SEQ ID NO: 441
  Synthetic polypeptide

SEQ ID NO: 11916 - DNA, 638 bp, Artificial Sequence; identical to SEQ ID NO: 442
  Synthetic polypeptide

SEQ ID NO: 11917 - DNA, 337 bp, Artificial Sequence; identical to SEQ ID NO: 443
  Synthetic polypeptide

SEQ ID NO: 11918 - DNA, 1052 bp, Artificial Sequence; identical to SEQ ID NO: 447
  Synthetic polypeptide

SEQ ID NO: 11919 - DNA, 1118 bp, Artificial Sequence; identical to SEQ ID NO: 448
  Synthetic polypeptide

SEQ ID NO: 11920 - DNA, 742 bp, Artificial Sequence; identical to SEQ ID NO: 6357
  Synthetic polypeptide

SEQ ID NO: 11921 - DNA, 590 bp, Artificial Sequence; identical to SEQ ID NO: 6358
  Synthetic polypeptide

SEQ ID NO: 11922 - DNA, 577 bp, Artificial Sequence; identical to SEQ ID NO: 6359
  Synthetic polypeptide

SEQ ID NO: 11923 - DNA, 430 bp, Artificial Sequence; identical to SEQ ID NO: 6360
  Synthetic polypeptide

SEQ ID NO: 11924 - DNA, 670 bp, Artificial Sequence; identical to SEQ ID NO: 6361
  Synthetic polypeptide

SEQ ID NO: 11925 - DNA, 906 bp, Artificial Sequence
  Synthetic polypeptide
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgatttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 11926 - DNA, 1216 bp, Artificial Sequence; identical to SEQ ID NO: 6819
  Synthetic polypeptide

SEQ ID NO: 11927 - DNA, 510 bp, Artificial Sequence; identical to SEQ ID NO: 6820
  Synthetic polypeptide

SEQ ID NO: 11928 - DNA, 1188 bp, Artificial Sequence; identical to SEQ ID NO: 8232
  Synthetic polypeptide

SEQ ID NO: 11929 - DNA, 337 bp, Artificial Sequence; identical to SEQ ID NO: 6393
  Synthetic polypeptide

SEQ ID NO: 11930 - DNA, 2537 bp, Artificial Sequence; identical to SEQ ID NO: 7357
  Synthetic polypeptide

SEQ ID NO: 11931 - DNA, 1913 bp, Artificial Sequence; identical to SEQ ID NO: 7358
  Synthetic polypeptide

SEQ ID NO: 11932 - DNA, 1871 bp, Artificial Sequence; identical to SEQ ID NO: 10627
  Synthetic polypeptide

SEQ ID NO: 11933 - DNA, 1625 bp, Artificial Sequence; identical to SEQ ID NO: 10628
  Synthetic polypeptide

SEQ ID NO: 11934 - DNA, 446 bp, Artificial Sequence; identical to SEQ ID NO: 10629
  Synthetic polypeptide

SEQ ID NO: 11935 - DNA, 594 bp, Artificial Sequence; identical to SEQ ID NO: 455
  Synthetic polypeptide

SEQ ID NO: 11936 - DNA, 1031 bp, Artificial Sequence; identical to SEQ ID NO: 456
  Synthetic polypeptide

SEQ ID NO: 11937 - DNA, 1019 bp, Artificial Sequence; identical to SEQ ID NO: 8194
  Synthetic polypeptide

SEQ ID NO: 11938 - DNA, 962 bp, Artificial Sequence; identical to SEQ ID NO: 8195
  Synthetic polypeptide

SEQ ID NO: 11939 - DNA, 287 bp, Artificial Sequence; identical to SEQ ID NO: 8196
  Synthetic polypeptide

SEQ ID NO: 11940 - DNA, 80 bp, Artificial Sequence; identical to SEQ ID NO: 6364
  Synthetic polypeptide

SEQ ID NO: 11941 - DNA, 217 bp, Artificial Sequence; identical to SEQ ID NO: 6365
  Synthetic polypeptide

SEQ ID NO: 11942 - DNA, 220 bp, Artificial Sequence; identical to SEQ ID NO: 7991
  Synthetic polypeptide

SEQ ID NO: 11943 - DNA, 334 bp, Artificial Sequence; identical to SEQ ID NO: 7992
  Synthetic polypeptide

SEQ ID NO: 11944 - DNA, 520 bp, Artificial Sequence; identical to SEQ ID NO: 6424
  Synthetic polypeptide

SEQ ID NO: 11945 - DNA, 1452 bp, Artificial Sequence; identical to SEQ ID NO: 7300
  Synthetic polypeptide

SEQ ID NO: 11946 - DNA, 1149 bp, Artificial Sequence; identical to SEQ ID NO: 7301
  Synthetic polypeptide

SEQ ID NO: 11947 - DNA, 1416 bp, Artificial Sequence; identical to SEQ ID NO: 7302
  Synthetic polypeptide

SEQ ID NO: 11948 - DNA, 1443 bp, Artificial Sequence; identical to SEQ ID NO: 7303
  Synthetic polypeptide

SEQ ID NO: 11949 - DNA, 1134 bp, Artificial Sequence; identical to SEQ ID NO: 7304
  Synthetic polypeptide

SEQ ID NO: 11950 - DNA, 839 bp, Artificial Sequence; identical to SEQ ID NO: 9123
  Synthetic polypeptide

SEQ ID NO: 11951 - DNA, 1854 bp, Artificial Sequence; identical to SEQ ID NO: 6613
  Synthetic polypeptide

SEQ ID NO: 11952 - DNA, 238 bp, Artificial Sequence; identical to SEQ ID NO: 6628
  Synthetic polypeptide

SEQ ID NO: 11953 - DNA, 486 bp, Artificial Sequence; identical to SEQ ID NO: 7296
  Synthetic polypeptide

SEQ ID NO: 11954 - DNA, 3055 bp, Artificial Sequence; identical to SEQ ID NO: 709
  Synthetic polypeptide

SEQ ID NO: 11955 - DNA, 3058 bp, Artificial Sequence; identical to SEQ ID NO: 710
  Synthetic polypeptide

SEQ ID NO: 11956 - DNA, 427 bp, Artificial Sequence; identical to SEQ ID NO: 573
  Synthetic polypeptide

SEQ ID NO: 11957 - DNA, 365 bp, Artificial Sequence; identical to SEQ ID NO: 6504
  Synthetic polypeptide

SEQ ID NO: 11958 - DNA, 509 bp, Artificial Sequence; identical to SEQ ID NO: 6505
  Synthetic polypeptide

SEQ ID NO: 11959 - DNA, 851 bp, Artificial Sequence; identical to SEQ ID NO: 8176
  Synthetic polypeptide

SEQ ID NO: 11960 - DNA, 1385 bp, Artificial Sequence; identical to SEQ ID NO: 8177
  Synthetic polypeptide

SEQ ID NO: 11961 - DNA, 299 bp, Artificial Sequence; identical to SEQ ID NO: 485
  Synthetic polypeptide

SEQ ID NO: 11962 - DNA, 576 bp, Artificial Sequence
  Synthetic polypeptide
tgatatggtttggctgtgtcgccatccaaatctcatcttgaatttccacatgttgtgggagggactcagtgggaggtaattgaaccatgggggcaggtctttcccatgctgttctcctgatagtgaataagtctcatgagatctgatggttttataaggcggagcttccctgcacaagctctctctctgcttgctgccatgcacgtaagatgtgatttgctcttctttatcttccaccatgattgtgaggcttccccagccacaaggaactaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaa

SEQ ID NO: 11963 - DNA, 1549 bp, Artificial Sequence
  Synthetic polypeptide
tgatatggtttggctgtgtcgccatccaaatctcatcttgaatttccacatgttgtgggagggactcagtgggaggtaattgaaccatgggggcaggtctttcccatgctgttctcctgatagtgaataagtctcatgagatctgatggttttataaggcggagcttccctgcacaagctctctctctgcttgctgccatgcacgtaagatgtgatttgctcttctttatcttccaccatgattgtgaggcttccccagccacaaggaactaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataa

SEQ ID NO: 11964 - DNA, 259 bp, Artificial Sequence; identical to SEQ ID NO: 7895
  Synthetic polypeptide

SEQ ID NO: 11965 - DNA, 310 bp, Artificial Sequence; identical to SEQ ID NO: 7896
  Synthetic polypeptide

SEQ ID NO: 11966 - DNA, 383 bp, Artificial Sequence; identical to SEQ ID NO: 8181
  Synthetic polypeptide

SEQ ID NO: 11967 - DNA, 637 bp, Artificial Sequence
  Synthetic polypeptide
actctgttcttcaagactttgcttggttgtcagctccccggaaactcttggctgactcacctgaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctga

SEQ ID NO: 11968 - DNA, 2521 bp, Artificial Sequence
  Synthetic polypeptide
actctgttcttcaagactttgcttggttgtcagctccccggaaactcttggctgactcacctgaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtag

SEQ ID NO: 11969 - DNA, 1267 bp, Artificial Sequence; identical to SEQ ID NO: 463
  Synthetic polypeptide

SEQ ID NO: 11970 - DNA, 2672 bp, Artificial Sequence; identical to SEQ ID NO: 6621
  Synthetic polypeptide

SEQ ID NO: 11971 - DNA, 1767 bp, Artificial Sequence; identical to SEQ ID NO: 6622
  Synthetic polypeptide

SEQ ID NO: 11972 - DNA, 1692 bp, Artificial Sequence; identical to SEQ ID NO: 6623
  Synthetic polypeptide

SEQ ID NO: 11973 - DNA, 2448 bp, Artificial Sequence; identical to SEQ ID NO: 6618
  Synthetic polypeptide

SEQ ID NO: 11974 - DNA, 1543 bp, Artificial Sequence; identical to SEQ ID NO: 6619
  Synthetic polypeptide

SEQ ID NO: 11975 - DNA, 1468 bp, Artificial Sequence; identical to SEQ ID NO: 6620
  Synthetic polypeptide

SEQ ID NO: 11976 - DNA, 1516 bp, Artificial Sequence; identical to SEQ ID NO: 534
  Synthetic polypeptide

SEQ ID NO: 11977 - DNA, 591 bp, Artificial Sequence; identical to SEQ ID NO: 539
  Synthetic polypeptide

SEQ ID NO: 11978 - DNA, 482 bp, Artificial Sequence; identical to SEQ ID NO: 540
  Synthetic polypeptide

SEQ ID NO: 11979 - DNA, 444 bp, Artificial Sequence; identical to SEQ ID NO: 541
  Synthetic polypeptide

SEQ ID NO: 11980 - DNA, 334 bp, Artificial Sequence; identical to SEQ ID NO: 533
  Synthetic polypeptide

SEQ ID NO: 11981 - DNA, 38 bp, Artificial Sequence; identical to SEQ ID NO: 543
  Synthetic polypeptide

SEQ ID NO: 11982 - DNA, 245 bp, Artificial Sequence; identical to SEQ ID NO: 542
  Synthetic polypeptide

SEQ ID NO: 11983 - DNA, 934 bp, Artificial Sequence
  Synthetic polypeptide
cattcctctgacttctgctccagtcactctactgaaactcctctcaatcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctga

SEQ ID NO: 11984 - DNA, 745 bp, Artificial Sequence
  Synthetic polypeptide
cattcctctgacttctgctccagtcactctactgaaactcctctcaatcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggtaataacataa

SEQ ID NO: 11985 - DNA, 545 bp, Artificial Sequence; identical to SEQ ID NO: 7336
  Synthetic polypeptide

SEQ ID NO: 11986 - DNA, 1409 bp, Artificial Sequence
  Synthetic polypeptide
ccactaaaaggtctagaaacaatgaccaacccagtatgaatgaacattcttagtgcccaaattatgatcttgaaataccatttacccatttagagaaactggggtttcttagggaaatggctaattctaggttttagggcaggaaatgtataggatgatcctagaatgttgtgataacagataacatgaaagtttatcaaagtctactggagtcatcttgaaaggacttaggatctaacttgaagaggctcccactgaccaaagagggataatttgagtttcagtaaggtaagaattgcaatagattaaaactcataaatatatttaaatccaggcactcataatgttactaaaaaggaaacctacttggctaaattaggagaattgataagaaatcagttcattgtattgaaaactggataaaggaaaaaaataagtatttgtcctgcctttcctgtaccactagataaccatatagtaggtgacagaaatatatctttataaaattatttcaacttacaaatgaaaacaaaatgataggatagcatcattttacaaccccttatggtctaggtactgagcatcaataactgctgacatcagaaacaaaaaccaagcctcctgacaaaagaacattacccaccaccaaagtttgccaaaaggataaaatccaaaattgatcaagcctctggatatagctgcaatttgcaagaaatactgaaaacaagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtag

SEQ ID NO: 11987 - DNA, 1373 bp, Artificial Sequence
  Synthetic polypeptide
ccactaaaaggtctagaaacaatgaccaacccagtatgaatgaacattcttagtgcccaaattatgatcttgaaataccatttacccatttagagaaactggggtttcttagggaaatggctaattctaggttttagggcaggaaatgtataggatgatcctagaatgttgtgataacagataacatgaaagtttatcaaagtctactggagtcatcttgaaaggacttaggatctaacttgaagaggctcccactgaccaaagagggataatttgagtttcagtaaggtaagaattgcaatagattaaaactcataaatatatttaaatccaggcactcataatgttactaaaaaggaaacctacttggctaaattaggagaattgataagaaatcagttcattgtattgaaaactggataaaggaaaaaaataagtatttgtcctgcctttcctgtaccactagataaccatatagtaggtgacagaaatatatctttataaaattatttcaacttacaaatgaaaacaaaatgataggatagcatcattttacaaccccttatggtctaggtactgagcatcaataactgctgacatcagaaacaaaaaccaagcctcctgacaaaagaacattacccaccaccaaagtttgccaaaaggataaaatccaaaattgatcaagcctctggatatagctgcaatttgcaagaaatactgaaaacaagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatgggcttctgtggtgatagaatggcaggtacttgtcctgaggccatcagagctgctggtgacaggacaccttcctga

SEQ ID NO: 11988 - DNA, 1185 bp, Artificial Sequence
  Synthetic polypeptide
ccactaaaaggtctagaaacaatgaccaacccagtatgaatgaacattcttagtgcccaaattatgatcttgaaataccatttacccatttagagaaactggggtttcttagggaaatggctaattctaggttttagggcaggaaatgtataggatgatcctagaatgttgtgataacagataacatgaaagtttatcaaagtctactggagtcatcttgaaaggacttaggatctaacttgaagaggctcccactgaccaaagagggataatttgagtttcagtaaggtaagaattgcaatagattaaaactcataaatatatttaaatccaggcactcataatgttactaaaaaggaaacctacttggctaaattaggagaattgataagaaatcagttcattgtattgaaaactggataaaggaaaaaaataagtatttgtcctgcctttcctgtaccactagataaccatatagtaggtgacagaaatatatctttataaaattatttcaacttacaaatgaaaacaaaatgataggatagcatcattttacaaccccttatggtctaggtactgagcatcaataactgctgacatcagaaacaaaaaccaagcctcctgacaaaagaacattacccaccaccaaagtttgccaaaaggataaaatccaaaattgatcaagcctctggatatagctgcaatttgcaagaaatactgaaaacaagcggcagtacatacctgtgaaaatgaagagcaaagccttctggatcttttcttgggagtatgccatgatatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgc

SEQ ID NO: 11989 - DNA, 448 bp, Artificial Sequence; identical to SEQ ID NO: 11129
  Synthetic polypeptide

SEQ ID NO: 11990 - DNA, 374 bp, Artificial Sequence; identical to SEQ ID NO: 11130
  Synthetic polypeptide

SEQ ID NO: 11991 - DNA, 543 bp, Artificial Sequence; identical to SEQ ID NO: 6496
  Synthetic polypeptide

SEQ ID NO: 11992 - DNA, 378 bp, Artificial Sequence; identical to SEQ ID NO: 6497
  Synthetic polypeptide

SEQ ID NO: 11993 - DNA, 267 bp, Artificial Sequence; identical to SEQ ID NO: 6498
  Synthetic polypeptide

SEQ ID NO: 11994 - DNA, 416 bp, Artificial Sequence; identical to SEQ ID NO: 6499
  Synthetic polypeptide

SEQ ID NO: 11995 - DNA, 162 bp, Artificial Sequence; identical to SEQ ID NO: 6500
  Synthetic polypeptide

SEQ ID NO: 11996 - DNA, 923 bp, Artificial Sequence
  Synthetic polypeptide
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtgggtggttgataagttttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 11997 - DNA, 883 bp, Artificial Sequence; identical to SEQ ID NO: 9631
  Synthetic polypeptide

SEQ ID NO: 11998 - DNA, 1023 bp, Artificial Sequence; identical to SEQ ID NO: 611
  Synthetic polypeptide

SEQ ID NO: 11999 - DNA, 1022 bp, Artificial Sequence; identical to SEQ ID NO: 590
  Synthetic polypeptide

SEQ ID NO: 12000 - DNA, 347 bp, Artificial Sequence; identical to SEQ ID NO: 591
  Synthetic polypeptide

SEQ ID NO: 12001 - DNA, 1109 bp, Artificial Sequence; identical to SEQ ID NO: 592
  Synthetic polypeptide

SEQ ID NO: 12002 - DNA, 85 bp, Artificial Sequence; identical to SEQ ID NO: 601
  Synthetic polypeptide

SEQ ID NO: 12003 - DNA, 269 bp, Artificial Sequence; identical to SEQ ID NO: 600
  Synthetic polypeptide

SEQ ID NO: 12004 - DNA, 1211 bp, Artificial Sequence; identical to SEQ ID NO: 526
  Synthetic polypeptide

SEQ ID NO: 12005 - DNA, 1133 bp, Artificial Sequence; identical to SEQ ID NO: 527
  Synthetic polypeptide

SEQ ID NO: 12006 - DNA, 841 bp, Artificial Sequence; identical to SEQ ID NO: 529
  Synthetic polypeptide

SEQ ID NO: 12007 - DNA, 659 bp, Artificial Sequence; identical to SEQ ID NO: 530
  Synthetic polypeptide

SEQ ID NO: 12008 - DNA, 1636 bp, Artificial Sequence; identical to SEQ ID NO: 531
  Synthetic polypeptide

SEQ ID NO: 12009 - DNA, 1328 bp, Artificial Sequence; identical to SEQ ID NO: 532
  Synthetic polypeptide

SEQ ID NO: 12010 - DNA, 852 bp, Artificial Sequence; identical to SEQ ID NO: 753
  Synthetic polypeptide

SEQ ID NO: 12011 - DNA, 809 bp, Artificial Sequence; identical to SEQ ID NO: 8505
  Synthetic polypeptide

SEQ ID NO: 12012 - DNA, 809 bp, Artificial Sequence; identical to SEQ ID NO: 8506
  Synthetic polypeptide

SEQ ID NO: 12013 - DNA, 809 bp, Artificial Sequence; identical to SEQ ID NO: 8586
  Synthetic polypeptide

SEQ ID NO: 12014 - DNA, 809 bp, Artificial Sequence; identical to SEQ ID NO: 8587
  Synthetic polypeptide

SEQ ID NO: 12015 - DNA, 809 bp, Artificial Sequence; identical to SEQ ID NO: 8613
  Synthetic polypeptide

SEQ ID NO: 12016 - DNA, 1691 bp, Artificial Sequence; identical to SEQ ID NO: 7480
  Synthetic polypeptide

SEQ ID NO: 12017 - DNA, 1727 bp, Artificial Sequence; identical to SEQ ID NO: 7481
  Synthetic polypeptide

SEQ ID NO: 12018 - DNA, 629 bp, Artificial Sequence; identical to SEQ ID NO: 7482
  Synthetic polypeptide

SEQ ID NO: 12019 - DNA, 1553 bp, Artificial Sequence; identical to SEQ ID NO: 7483
  Synthetic polypeptide

SEQ ID NO: 12020 - DNA, 2120 bp, Artificial Sequence; identical to SEQ ID NO: 6752
  Synthetic polypeptide

SEQ ID NO: 12021 - DNA, 1046 bp, Artificial Sequence; identical to SEQ ID NO: 631
  Synthetic polypeptide

SEQ ID NO: 12022 - DNA, 968 bp, Artificial Sequence; identical to SEQ ID NO: 632
  Synthetic polypeptide

SEQ ID NO: 12023 - DNA, 676 bp, Artificial Sequence; identical to SEQ ID NO: 634
  Synthetic polypeptide

SEQ ID NO: 12024 - DNA, 494 bp, Artificial Sequence; identical to SEQ ID NO: 635
  Synthetic polypeptide

SEQ ID NO: 12025 - DNA, 809 bp, Artificial Sequence; identical to SEQ ID NO: 8505
  Synthetic polypeptide

SEQ ID NO: 12026 - DNA, 809 bp, Artificial Sequence; identical to SEQ ID NO: 8643
  Synthetic polypeptide

SEQ ID NO: 12027 - DNA, 809 bp, Artificial Sequence; identical to SEQ ID NO: 8643
  Synthetic polypeptide

SEQ ID NO: 12028 - DNA, 952 bp, Artificial Sequence; identical to SEQ ID NO: 8583
  Synthetic polypeptide

SEQ ID NO: 12029 - DNA, 87 bp, Artificial Sequence; identical to SEQ ID NO: 8584
  Synthetic polypeptide

SEQ ID NO: 12030 - DNA, 809 bp, Artificial Sequence; identical to SEQ ID NO: 8699
  Synthetic polypeptide

SEQ ID NO: 12031 - DNA, 809 bp, Artificial Sequence; identical to SEQ ID NO: 8699
  Synthetic polypeptide

SEQ ID NO: 12032 - DNA, 463 bp, Artificial Sequence; identical to SEQ ID NO: 524
  Synthetic polypeptide

SEQ ID NO: 12033 - DNA, 1084 bp, Artificial Sequence; identical to SEQ ID NO: 580
  Synthetic polypeptide

SEQ ID NO: 12034 - DNA, 278 bp, Artificial Sequence; identical to SEQ ID NO: 8451
  Synthetic polypeptide

SEQ ID NO: 12035 - DNA, 136 bp, Artificial Sequence; identical to SEQ ID NO: 8452
  Synthetic polypeptide

SEQ ID NO: 12036 - DNA, 809 bp, Artificial Sequence; identical to SEQ ID NO: 8613
  Synthetic polypeptide

SEQ ID NO: 12037 - DNA, 364 bp, Artificial Sequence; identical to SEQ ID NO: 7502
  Synthetic polypeptide

SEQ ID NO: 12038 - DNA, 785 bp, Artificial Sequence; identical to SEQ ID NO: 6642
  Synthetic polypeptide

SEQ ID NO: 12039 - DNA, 440 bp, Artificial Sequence; identical to SEQ ID NO: 6643
  Synthetic polypeptide

SEQ ID NO: 12040 - DNA, 1232 bp, Artificial Sequence; identical to SEQ ID NO: 6566
  Synthetic polypeptide

SEQ ID NO: 12041 - DNA, 497 bp, Artificial Sequence; identical to SEQ ID NO: 6567
  Synthetic polypeptide

SEQ ID NO: 12042 - DNA, 575 bp, Artificial Sequence; identical to SEQ ID NO: 6568
  Synthetic polypeptide

SEQ ID NO: 12043 - DNA, 2111 bp, Artificial Sequence
  Synthetic polypeptide
gggtccccaagtcccccgtccacagaccagtaccaatctatggccggttaggaacggggctttcacagcaagaagtgagtggcaggccagagagcaaagcttcacctgtttttacagccactccccattgctcaaattacggcctgaactccacctcctgtaagatcagcagtggtattagatgctcaaaggagcgcaaaccctactgtgaactgtgcatataggggatctgggttgtgcgctccttatgagaatctaatgcctgatgatctgtcactgtctcccatcacctccagatgaaaatgtctagttgcaggaaaacgagctcaggctaccattgattctacgttatggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtacccctacgacctggtgcggtccccctggaagacgcaggaacacacccccacccccgacgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcagaagagacgacagcgtgggtga

SEQ ID NO: 12044 - DNA, 1194 bp, Artificial Sequence; identical to SEQ ID NO: 898
  Synthetic polypeptide

SEQ ID NO: 12045 - DNA, 1116 bp, Artificial Sequence; identical to SEQ ID NO: 899
  Synthetic polypeptide

SEQ ID NO: 12046 - DNA, 824 bp, Artificial Sequence; identical to SEQ ID NO: 901
  Synthetic polypeptide

SEQ ID NO: 12047 - DNA, 642 bp, Artificial Sequence; identical to SEQ ID NO: 902
  Synthetic polypeptide

SEQ ID NO: 12048 - DNA, 285 bp, Artificial Sequence; identical to SEQ ID NO: 6932
  Synthetic polypeptide

SEQ ID NO: 12049 - DNA, 333 bp, Artificial Sequence; identical to SEQ ID NO: 6933
  Synthetic polypeptide

SEQ ID NO: 12050 - DNA, 207 bp, Artificial Sequence; identical to SEQ ID NO: 6934
  Synthetic polypeptide

SEQ ID NO: 12051 - DNA, 555 bp, Artificial Sequence; identical to SEQ ID NO: 6935
  Synthetic polypeptide

SEQ ID NO: 12052 - DNA, 225 bp, Artificial Sequence; identical to SEQ ID NO: 6936
  Synthetic polypeptide

SEQ ID NO: 12053 - DNA, 1815 bp, Artificial Sequence; identical to SEQ ID NO: 581
  Synthetic polypeptide

SEQ ID NO: 12054 - DNA, 423 bp, Artificial Sequence; identical to SEQ ID NO: 6550
  Synthetic polypeptide

SEQ ID NO: 12055 - DNA, 1530 bp, Artificial Sequence; identical to SEQ ID NO: 7238
  Synthetic polypeptide

SEQ ID NO: 12056 - DNA, 369 bp, Artificial Sequence; identical to SEQ ID NO: 7239
  Synthetic polypeptide

SEQ ID NO: 12057 - DNA, 342 bp, Artificial Sequence; identical to SEQ ID NO: 7240
  Synthetic polypeptide

SEQ ID NO: 12058 - DNA, 1419 bp, Artificial Sequence; identical to SEQ ID NO: 7241
  Synthetic polypeptide

SEQ ID NO: 12059 - DNA, 864 bp, Artificial Sequence; identical to SEQ ID NO: 6975
  Synthetic polypeptide

SEQ ID NO: 12060 - DNA, 471 bp, Artificial Sequence; identical to SEQ ID NO: 6976
  Synthetic polypeptide

SEQ ID NO: 12061 - DNA, 1775 bp, Artificial Sequence; identical to SEQ ID NO: 568
  Synthetic polypeptide

SEQ ID NO: 12062 - DNA, 1038 bp, Artificial Sequence
  Synthetic polypeptide
tgctatagactgaatgcttgtatcccttctcaaattcatatgttgaaattctaacgcataacgtggtggtactaagaggtggggcttttgggaggtaattagatcatgagaggagagccctcatgaatgggcttagtgccctgataaagcaatacaagagagcttgcttcctctctctgttctctaccaaaggagaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataa

SEQ ID NO: 12063 - DNA, 842 bp, Artificial Sequence; identical to SEQ ID NO: 6534
  Synthetic polypeptide

SEQ ID NO: 12064 - DNA, 1931 bp, Artificial Sequence; identical to SEQ ID NO: 7491
  Synthetic polypeptide

SEQ ID NO: 12065 - DNA, 2578 bp, Artificial Sequence; identical to SEQ ID NO: 7194
  Synthetic polypeptide

SEQ ID NO: 12066 - DNA, 2305 bp, Artificial Sequence; identical to SEQ ID NO: 7195
  Synthetic polypeptide

SEQ ID NO: 12067 - DNA, 1759 bp, Artificial Sequence; identical to SEQ ID NO: 7196
  Synthetic polypeptide

SEQ ID NO: 12068 - DNA, 5464 bp, Artificial Sequence; identical to SEQ ID NO: 7409
  Synthetic polypeptide

SEQ ID NO: 12069 - DNA, 4444 bp, Artificial Sequence; identical to SEQ ID NO: 7410
  Synthetic polypeptide

SEQ ID NO: 12070 - DNA, 574 bp, Artificial Sequence; identical to SEQ ID NO: 7411
  Synthetic polypeptide

SEQ ID NO: 12071 - DNA, 236 bp, Artificial Sequence; identical to SEQ ID NO: 9570
  Synthetic polypeptide

SEQ ID NO: 12072 - DNA, 542 bp, Artificial Sequence; identical to SEQ ID NO: 9571
  Synthetic polypeptide

SEQ ID NO: 12073 - DNA, 1214 bp, Artificial Sequence; identical to SEQ ID NO: 9572
  Synthetic polypeptide

SEQ ID NO: 12074 - DNA, 144 bp, Artificial Sequence; identical to SEQ ID NO: 9573
  Synthetic polypeptide

SEQ ID NO: 12075 - DNA, 515 bp, Artificial Sequence; identical to SEQ ID NO: 9574
  Synthetic polypeptide

SEQ ID NO: 12076 - DNA, 4048 bp, Artificial Sequence; identical to SEQ ID NO: 9554
  Synthetic polypeptide

SEQ ID NO: 12077 - DNA, 466 bp, Artificial Sequence; identical to SEQ ID NO: 8369
  Synthetic polypeptide

SEQ ID NO: 12078 - DNA, 526 bp, Artificial Sequence; identical to SEQ ID NO: 8370
  Synthetic polypeptide

SEQ ID NO: 12079 - DNA, 319 bp, Artificial Sequence; identical to SEQ ID NO: 8371
  Synthetic polypeptide

SEQ ID NO: 12080 - DNA, 520 bp, Artificial Sequence; identical to SEQ ID NO: 8372
  Synthetic polypeptide

SEQ ID NO: 12081 - DNA, 763 bp, Artificial Sequence; identical to SEQ ID NO: 606
  Synthetic polypeptide

SEQ ID NO: 12082 - DNA, 375 bp, Artificial Sequence; identical to SEQ ID NO: 860
  Synthetic polypeptide

SEQ ID NO: 12083 - DNA, 255 bp, Artificial Sequence; identical to SEQ ID NO: 862
  Synthetic polypeptide

SEQ ID NO: 12084 - DNA, 1967 bp, Artificial Sequence; identical to SEQ ID NO: 7428
  Synthetic polypeptide

SEQ ID NO: 12085 - DNA, 1142 bp, Artificial Sequence; identical to SEQ ID NO: 7429
  Synthetic polypeptide

SEQ ID NO: 12086 - DNA, 367 bp, Artificial Sequence; identical to SEQ ID NO: 548
  Synthetic polypeptide

SEQ ID NO: 12087 - DNA, 761 bp, Artificial Sequence; identical to SEQ ID NO: 7260
  Synthetic polypeptide

SEQ ID NO: 12088 - DNA, 675 bp, Artificial Sequence; identical to SEQ ID NO: 7261
  Synthetic polypeptide

SEQ ID NO: 12089 - DNA, 779 bp, Artificial Sequence; identical to SEQ ID NO: 8578
  Synthetic polypeptide

SEQ ID NO: 12090 - DNA, 409 bp, Artificial Sequence; identical to SEQ ID NO: 8579
  Synthetic polypeptide

SEQ ID NO: 12091 - DNA, 1498 bp, Artificial Sequence; identical to SEQ ID NO: 8305
  Synthetic polypeptide

SEQ ID NO: 12092 - DNA, 1195 bp, Artificial Sequence; identical to SEQ ID NO: 8306
  Synthetic polypeptide

SEQ ID NO: 12093 - DNA, 1462 bp, Artificial Sequence; identical to SEQ ID NO: 8307
  Synthetic polypeptide

SEQ ID NO: 12094 - DNA, 1489 bp, Artificial Sequence; identical to SEQ ID NO: 8308
  Synthetic polypeptide

SEQ ID NO: 12095 - DNA, 1180 bp, Artificial Sequence; identical to SEQ ID NO: 8309
  Synthetic polypeptide

SEQ ID NO: 12096 - DNA, 829 bp, Artificial Sequence; identical to SEQ ID NO: 6626
  Synthetic polypeptide

SEQ ID NO: 12097 - DNA, 484 bp, Artificial Sequence; identical to SEQ ID NO: 6627
  Synthetic polypeptide

SEQ ID NO: 12098 - DNA, 233 bp, Artificial Sequence; identical to SEQ ID NO: 9987
  Synthetic polypeptide

SEQ ID NO: 12099 - DNA, 585 bp, Artificial Sequence; identical to SEQ ID NO: 9988
  Synthetic polypeptide

SEQ ID NO: 12100 - DNA, 342 bp, Artificial Sequence; identical to SEQ ID NO: 9989
  Synthetic polypeptide

SEQ ID NO: 12101 - DNA, 346 bp, Artificial Sequence; identical to SEQ ID NO: 9990
  Synthetic polypeptide

SEQ ID NO: 12102 - DNA, 3052 bp, Artificial Sequence; identical to SEQ ID NO: 7029
  Synthetic polypeptide

SEQ ID NO: 12103 - DNA, 3055 bp, Artificial Sequence; identical to SEQ ID NO: 7030
  Synthetic polypeptide

SEQ ID NO: 12104 - DNA, 3140 bp, Artificial Sequence; identical to SEQ ID NO: 9634
  Synthetic polypeptide

SEQ ID NO: 12105 - DNA, 3209 bp, Artificial Sequence; identical to SEQ ID NO: 9635
  Synthetic polypeptide

SEQ ID NO: 12106 - DNA, 2637 bp, Artificial Sequence; identical to SEQ ID NO: 9636
  Synthetic polypeptide

SEQ ID NO: 12107 - DNA, 823 bp, Artificial Sequence
  Synthetic polypeptide
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagttttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12108 - DNA, 340 bp, Artificial Sequence; identical to SEQ ID NO: 8550
  Synthetic polypeptide

SEQ ID NO: 12109 - DNA, 249 bp, Artificial Sequence
  Synthetic polypeptide
aagacggccgaataggaacagctccggtctacagctcccagcgtgagcaatgcagaagaccggtgatttctgcatttccatctgaggtaccgggttcatctcactagggagtgccagacagtgggcgcagtgtgtatgtacagagaaccatcgctacatgaaattggagaaaaacaagggcgttcaaggaaaagttctggaacaccaaccatgaatggaggcaaagttgtgaatcaagattcaacatag

SEQ ID NO: 12110 - DNA, 198 bp, Artificial Sequence
  Synthetic polypeptide
aagacggccgaataggaacagctccggtctacagctcccagcgtgagcaatgcagaagaccggtgatttctgcatttccatctgaggtaccgggttcatctcactagggagtgccagacagtgggcgcagtgtgtatgtacagagaaccatcgctacatgaaattggagaaaaacaagggcgttcaaggaaaagttct

SEQ ID NO: 12111 - DNA, 2322 bp, Artificial Sequence; identical to SEQ ID NO: 7493
  Synthetic polypeptide

SEQ ID NO: 12112 - DNA, 1698 bp, Artificial Sequence; identical to SEQ ID NO: 7494
  Synthetic polypeptide

SEQ ID NO: 12113 - DNA, 784 bp, Artificial Sequence; identical to SEQ ID NO: 6798
  Synthetic polypeptide

SEQ ID NO: 12114 - DNA, 1257 bp, Artificial Sequence; identical to SEQ ID NO: 625
  Synthetic polypeptide

SEQ ID NO: 12115 - DNA, 1215 bp, Artificial Sequence; identical to SEQ ID NO: 626
  Synthetic polypeptide

SEQ ID NO: 12116 - DNA, 507 bp, Artificial Sequence; identical to SEQ ID NO: 628
  Synthetic polypeptide

SEQ ID NO: 12117 - DNA, 313 bp, Artificial Sequence; identical to SEQ ID NO: 629
  Synthetic polypeptide

SEQ ID NO: 12118 - DNA, 291 bp, Artificial Sequence; identical to SEQ ID NO: 630
  Synthetic polypeptide

SEQ ID NO: 12119 - DNA, 463 bp, Artificial Sequence; identical to SEQ ID NO: 7109
  Synthetic polypeptide

SEQ ID NO: 12120 - DNA, 156 bp, Artificial Sequence; identical to SEQ ID NO: 6906
  Synthetic polypeptide

SEQ ID NO: 12121 - DNA, 153 bp, Artificial Sequence; identical to SEQ ID NO: 11159
  Synthetic polypeptide

SEQ ID NO: 12122 - DNA, 1608 bp, Artificial Sequence; identical to SEQ ID NO: 11160
  Synthetic polypeptide

SEQ ID NO: 12123 - DNA, 509 bp, Artificial Sequence; identical to SEQ ID NO: 7445
  Synthetic polypeptide

SEQ ID NO: 12124 - DNA, 1052 bp, Artificial Sequence; identical to SEQ ID NO: 789
  Synthetic polypeptide

SEQ ID NO: 12125 - DNA, 974 bp, Artificial Sequence; identical to SEQ ID NO: 790
  Synthetic polypeptide

SEQ ID NO: 12126 - DNA, 682 bp, Artificial Sequence; identical to SEQ ID NO: 792
  Synthetic polypeptide

SEQ ID NO: 12127 - DNA, 500 bp, Artificial Sequence; identical to SEQ ID NO: 793
  Synthetic polypeptide

SEQ ID NO: 12128 - DNA, 1206 bp, Artificial Sequence; identical to SEQ ID NO: 7670
  Synthetic polypeptide

SEQ ID NO: 12129 - DNA, 1134 bp, Artificial Sequence; identical to SEQ ID NO: 7671
  Synthetic polypeptide

SEQ ID NO: 12130 - DNA, 1002 bp, Artificial Sequence; identical to SEQ ID NO: 7672
  Synthetic polypeptide

SEQ ID NO: 12131 - DNA, 287 bp, Artificial Sequence; identical to SEQ ID NO: 7101
  Synthetic polypeptide

SEQ ID NO: 12132 - DNA, 281 bp, Artificial Sequence; identical to SEQ ID NO: 7102
  Synthetic polypeptide

SEQ ID NO: 12133 - DNA, 630 bp, Artificial Sequence
  Synthetic polypeptide
tggtctcatcttctaccgattcctcgccctgtaccaccactaggttccctatgctccagccacagacctttttttctgttccttacaaactacaagatcatcactgcttctgggcttttgtgcacttagatccctgaaatcacctcatatcatgcaggtctcagctcacttgtcgccacttcagagaaacctactttcatcctccaaactgaagaaggcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtga

SEQ ID NO: 12134 - DNA, 127 bp, Artificial Sequence; identical to SEQ ID NO: 8697
  Synthetic polypeptide

SEQ ID NO: 12135 - DNA, 785 bp, Artificial Sequence
  Synthetic polypeptide
gggggaggagccaagatggccgaataggaacagctccggtgtacagctcccagcgtgagcgacgcagaagacgggtgatttctgcatttccatctgaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttag

SEQ ID NO: 12136 - DNA, 440 bp, Artificial Sequence
  Synthetic polypeptide
gggggaggagccaagatggccgaataggaacagctccggtgtacagctcccagcgtgagcgacgcagaagacgggtgatttctgcatttccatctgaggctggaagtgatggagagagtattggaaactgtcccttttgccaacgccttttcatgatcctctggcttaaaggagttaaatttaatgtgacaactgttgacatgaccaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggat

SEQ ID NO: 12137 - DNA, 2419 bp, Artificial Sequence; identical to SEQ ID NO: 7455
  Synthetic polypeptide

SEQ ID NO: 12138 - DNA, 829 bp, Artificial Sequence; identical to SEQ ID NO: 624
  Synthetic polypeptide

SEQ ID NO: 12139 - DNA, 665 bp, Artificial Sequence; identical to SEQ ID NO: 6745
  Synthetic polypeptide

SEQ ID NO: 12140 - DNA, 1443 bp, Artificial Sequence; identical to SEQ ID NO: 6760
  Synthetic polypeptide

SEQ ID NO: 12141 - DNA, 984 bp, Artificial Sequence; identical to SEQ ID NO: 6761
  Synthetic polypeptide

SEQ ID NO: 12142 - DNA, 1032 bp, Artificial Sequence; identical to SEQ ID NO: 6762
  Synthetic polypeptide

SEQ ID NO: 12143 - DNA, 1533 bp, Artificial Sequence; identical to SEQ ID NO: 8543
  Synthetic polypeptide

SEQ ID NO: 12144 - DNA, 1392 bp, Artificial Sequence; identical to SEQ ID NO: 6782
  Synthetic polypeptide

SEQ ID NO: 12145 - DNA, 933 bp, Artificial Sequence; identical to SEQ ID NO: 6783
  Synthetic polypeptide

SEQ ID NO: 12146 - DNA, 981 bp, Artificial Sequence; identical to SEQ ID NO: 6784
  Synthetic polypeptide

SEQ ID NO: 12147 - DNA, 711 bp, Artificial Sequence; identical to SEQ ID NO: 7377
  Synthetic polypeptide

SEQ ID NO: 12148 - DNA, 503 bp, Artificial Sequence; identical to SEQ ID NO: 493
  Synthetic polypeptide

SEQ ID NO: 12149 - DNA, 476 bp, Artificial Sequence; identical to SEQ ID NO: 495
  Synthetic polypeptide

SEQ ID NO: 12150 - DNA, 539 bp, Artificial Sequence; identical to SEQ ID NO: 496
  Synthetic polypeptide

SEQ ID NO: 12151 - DNA, 2535 bp, Artificial Sequence; identical to SEQ ID NO: 6677
  Synthetic polypeptide

SEQ ID NO: 12152 - DNA, 2181 bp, Artificial Sequence; identical to SEQ ID NO: 6678
  Synthetic polypeptide

SEQ ID NO: 12153 - DNA, 1119 bp, Artificial Sequence; identical to SEQ ID NO: 6679
  Synthetic polypeptide

SEQ ID NO: 12154 - DNA, 1808 bp, Artificial Sequence
  Synthetic polypeptide
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtga

SEQ ID NO: 12155 - DNA, 1496 bp, Artificial Sequence
  Synthetic polypeptide
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtatctatggctttttcaaccaggctttcttggtgttttttatcttggtttgtttgtttgaattcctcagcaacatctacagcaaataa

SEQ ID NO: 12156 - DNA, 2126 bp, Artificial Sequence
  Synthetic polypeptide
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaa

SEQ ID NO: 12157 - DNA, 302 bp, Artificial Sequence
  Synthetic polypeptide
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgaggtgatgtggaaacagctgtaa

SEQ ID NO: 12158 - DNA, 652 bp, Artificial Sequence
  Synthetic polypeptide
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatt

SEQ ID NO: 12159 - DNA, 809 bp, Artificial Sequence
  Synthetic polypeptide
cctggttctctggggcacgaggcttctcctcagcactctggcgcccccaacaggttcccagtgttcggctggggcaggcacgctgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgctgtctctcctccagcaagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 12160 - DNA, 718 bp, Artificial Sequence; identical to SEQ ID NO: 821
  Synthetic polypeptide

SEQ ID NO: 12161 - DNA, 369 bp, Artificial Sequence; identical to SEQ ID NO: 6492
  Synthetic polypeptide

SEQ ID NO: 12162 - DNA, 233 bp, Artificial Sequence; identical to SEQ ID NO: 856
  Synthetic polypeptide

SEQ ID NO: 12163 - DNA, 610 bp, Artificial Sequence; identical to SEQ ID NO: 8445
  Synthetic polypeptide

SEQ ID NO: 12164 - DNA, 1047 bp, Artificial Sequence; identical to SEQ ID NO: 8446
  Synthetic polypeptide

SEQ ID NO: 12165 - DNA, 809 bp, Artificial Sequence
  Synthetic polypeptide
cctggttctctggggcacgaggcttctcctcagcactctggcgcccccaacaggttcccagtgttcggctggggcaggcacgctgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgctgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 12166 - DNA, 1083 bp, Artificial Sequence; identical to SEQ ID NO: 7080
  Synthetic polypeptide

SEQ ID NO: 12167 - DNA, 809 bp, Artificial Sequence
  Synthetic polypeptide
cctggttctctggggcacgaggcttctcctcagcactctggcgcccccaacaggttcccagtgttcggctggggcaggcacgctgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgctgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12168 - DNA, 499 bp, Artificial Sequence
  Synthetic polypeptide
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcag

SEQ ID NO: 12169 - DNA, 642 bp, Artificial Sequence
  Synthetic polypeptide
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataa

SEQ ID NO: 12170 - DNA, 696 bp, Artificial Sequence
  Synthetic polypeptide
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagctggctccagaagaatgatcagattccggtttgattcctttgacaaaactatagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataa

SEQ ID NO: 12171 - DNA, 441 bp, Artificial Sequence
  Synthetic polypeptide
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataa

SEQ ID NO: 12172 - DNA, 371 bp, Artificial Sequence
  Synthetic polypeptide
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataaccc

SEQ ID NO: 12173 - DNA, 2546 bp, Artificial Sequence
  Synthetic polypeptide
ctagaatttctgctgtaggaggtacttatgcagtaatctcgttgggaggcggagactggagttggagtcttaagagttgtgtttttgcgaacatcctaagcacgttcttggttatttcaattgtagcttattggaggtgcttgggagatggggggaggcggaaacctgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaa

SEQ ID NO: 12174 - DNA, 929 bp, Artificial Sequence
  Synthetic polypeptide
ctagaatttctgctgtaggaggtacttatgcagtaatctcgttgggaggcggagactggagttggagtcttaagagttgtgtttttgcgaacatcctaagcacgttcttggttatttcaattgtagcttattggaggtgcttgggagatggggggaggcggaaacctgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagttattatttgaatag

SEQ ID NO: 12175 - DNA, 853 bp, Artificial Sequence; identical to SEQ ID NO: 9052
  Synthetic polypeptide

SEQ ID NO: 12176 - DNA, 265 bp, Artificial Sequence; identical to SEQ ID NO: 9053
  Synthetic polypeptide

SEQ ID NO: 12177 - DNA, 7177 bp, Artificial Sequence; identical to SEQ ID NO: 574
  Synthetic polypeptide

SEQ ID NO: 12178 - DNA, 7195 bp, Artificial Sequence; identical to SEQ ID NO: 575
  Synthetic polypeptide

SEQ ID NO: 12179 - DNA, 763 bp, Artificial Sequence; identical to SEQ ID NO: 9627
  Synthetic polypeptide

SEQ ID NO: 12180 - DNA, 2264 bp, Artificial Sequence; identical to SEQ ID NO: 9628
  Synthetic polypeptide

SEQ ID NO: 12181 - DNA, 4725 bp, Artificial Sequence; identical to SEQ ID NO: 8344
  Synthetic polypeptide

SEQ ID NO: 12182 - DNA, 4530 bp, Artificial Sequence; identical to SEQ ID NO: 8345
  Synthetic polypeptide

SEQ ID NO: 12183 - DNA, 4557 bp, Artificial Sequence; identical to SEQ ID NO: 8346
  Synthetic polypeptide

SEQ ID NO: 12184 - DNA, 4380 bp, Artificial Sequence; identical to SEQ ID NO: 8347
  Synthetic polypeptide

SEQ ID NO: 12185 - DNA, 4548 bp, Artificial Sequence; identical to SEQ ID NO: 8348
  Synthetic polypeptide

SEQ ID NO: 12186 - DNA, 4755 bp, Artificial Sequence; identical to SEQ ID NO: 8349
  Synthetic polypeptide

SEQ ID NO: 12187 - DNA, 1490 bp, Artificial Sequence; identical to SEQ ID NO: 7414
  Synthetic polypeptide

SEQ ID NO: 12188 - DNA, 1031 bp, Artificial Sequence; identical to SEQ ID NO: 7415
  Synthetic polypeptide

SEQ ID NO: 12189 - DNA, 1079 bp, Artificial Sequence; identical to SEQ ID NO: 7416
  Synthetic polypeptide

SEQ ID NO: 12190 - DNA, 974 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatgctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12191 - DNA, 896 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatgctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12192 - DNA, 604 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatgctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 12193 - DNA, 422 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatgctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 12194 - DNA, 380 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtgtttgaattccagttgacttcagaggagatgaaagccatagatggcctaaacagaaatgtgcgatatttgacccttgatatttttgctggcccccctaattatccattttctgatgaatattaa

SEQ ID NO: 12195 - DNA, 347 bp, Artificial Sequence; identical to SEQ ID NO: 452
  Synthetic polypeptide

SEQ ID NO: 12196 - DNA, 148 bp, Artificial Sequence; identical to SEQ ID NO: 454
  Synthetic polypeptide

SEQ ID NO: 12197 - DNA, 1222 bp, Artificial Sequence
  Synthetic polypeptide
gagtgtaagagtggttgaggcttggcacttgccacctagatttcagacaatgtgtcaggaatcctggatacccagagagaatcctgttccagggccggatccccaacataaagcttttatttaggcaatgttgagcactaatatgtggttggagctctgcagggggtctccatgggtgcactgtgtagcaaagctgtgggagaaaggccttacccctcaaaattccagaattataaatctaccaggcgctaacaacttcagcctggaaaagccatgggcattaaactccaaactgtgagagcagccatgtgggctgcaccctgcaaagccacaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12198 - DNA, 862 bp, Artificial Sequence
  Synthetic polypeptide
gagtgtaagagtggttgaggcttggcacttgccacctagatttcagacaatgtgtcaggaatcctggatacccagagagaatcctgttccagggccggatccccaacataaagcttttatttaggcaatgttgagcactaatatgtggttggagctctgcagggggtctccatgggtgcactgtgtagcaaagctgtgggagaaaggccttacccctcaaaattccagaattataaatctaccaggcgctaacaacttcagcctggaaaagccatgggcattaaactccaaactgtgagagcagccatgtgggctgcaccctgcaaagccacaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 12199 - DNA, 527 bp, Artificial Sequence
  Synthetic polypeptide
ggccaggtacagtggctcacacctgtaatcccagcactatggggggctgagacggtcggatcacctgaggttaggagttggagaccagcctgaccaacacggagaaaccctgtctctactaaaaatacaaaatcagctgggcatggtggcgggtgcctgtaatcccagctactcgggaggctgaggcgggagaatcacttgaacccggaaggtggaggttgcagtgagctgagattgcgccattggactccagcttggtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttga

SEQ ID NO: 12200 - DNA, 665 bp, Artificial Sequence
  Synthetic polypeptide
ggccaggtacagtggctcacacctgtaatcccagcactatggggggctgagacggtcggatcacctgaggttaggagttggagaccagcctgaccaacacggagaaaccctgtctctactaaaaatacaaaatcagctgggcatggtggcgggtgcctgtaatcccagctactcgggaggctgaggcgggagaatcacttgaacccggaaggtggaggttgcagtgagctgagattgcgccattggactccagcttggtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactag

SEQ ID NO: 12201 - DNA, 575 bp, Artificial Sequence
  Synthetic polypeptide
ggccaggtacagtggctcacacctgtaatcccagcactatggggggctgagacggtcggatcacctgaggttaggagttggagaccagcctgaccaacacggagaaaccctgtctctactaaaaatacaaaatcagctgggcatggtggcgggtgcctgtaatcccagctactcgggaggctgaggcgggagaatcacttgaacccggaaggtggaggttgcagtgagctgagattgcgccattggactccagcttggtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatggtaagacatgctggtcggtggctccccgtggctgtgggtactgggagcagagccccttctcactcgtggtttcggttctgactgtaacaattttagcttttgtctga

SEQ ID NO: 12202 - DNA, 1653 bp, Artificial Sequence
  Synthetic polypeptide
tgatatggtctggctctgtgtccccacccaaatctgatcttgtaactcccataattcccatgtgttgtgggaggaacccagtgggagatgattgagtcatgggggtgggtctttaccctgctgttctcatgatagtgcatgagtctcatgagatctgatggttttaaaaaacaggagttgccctgaacaagctctcttttttcctgccgtcatccatttaagatgtgacttactcctccttaccgtccgccatgactgtgaggtctccccagccacatggaactaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattag

SEQ ID NO: 12203 - DNA, 1590 bp, Artificial Sequence
  Synthetic polypeptide
tgatatggtctggctctgtgtccccacccaaatctgatcttgtaactcccataattcccatgtgttgtgggaggaacccagtgggagatgattgagtcatgggggtgggtctttaccctgctgttctcatgatagtgcatgagtctcatgagatctgatggttttaaaaaacaggagttgccctgaacaagctctcttttttcctgccgtcatccatttaagatgtgacttactcctccttaccgtccgccatgactgtgaggtctccccagccacatggaactaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattag

SEQ ID NO: 12204 - DNA, 1503 bp, Artificial Sequence; identical to SEQ ID NO: 8103
  Synthetic polypeptide

SEQ ID NO: 12205 - DNA, 645 bp, Artificial Sequence; identical to SEQ ID NO: 8104
  Synthetic polypeptide

SEQ ID NO: 12206 - DNA, 343 bp, Artificial Sequence; identical to SEQ ID NO: 8105
  Synthetic polypeptide

SEQ ID NO: 12207 - DNA, 489 bp, Artificial Sequence
  Synthetic polypeptide
ccaagatggccaaataggaacagctccagtctacagctcccagcgtgagtgacgcagaagatgggtgatttctgcatttccaactgaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtag

SEQ ID NO: 12208 - DNA, 74 bp, Artificial Sequence; identical to SEQ ID NO: 7010
  Synthetic polypeptide

SEQ ID NO: 12209 - DNA, 826 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12210 - DNA, 373 bp, Artificial Sequence; identical to SEQ ID NO: 896
  Synthetic polypeptide

SEQ ID NO: 12211 - DNA, 335 bp, Artificial Sequence
  Synthetic polypeptide
tgttatggattgaatgcgtgttcctccaaaatttcatatgttacaatcctaaccccaatggtgatgacattagaaggtagagtttggaggaggtaattaggtcatgagggtggacccctcatgaatgggttgaatacccttagaaaagcgacttcagagagctctctctctttctaccaggtgaggatacagtgagaagacagccgtctgcaatcaggaaggggactctcaccagacaacaagtcttccagcacctttatcttggacttccagcctccagaattatgacaaaagcggttattgagcattcgctgtgtaccaagtgctgtccttga

SEQ ID NO: 12212 - DNA, 1217 bp, Artificial Sequence; identical to SEQ ID NO: 765
  Synthetic polypeptide

SEQ ID NO: 12213 - DNA, 1139 bp, Artificial Sequence; identical to SEQ ID NO: 766
  Synthetic polypeptide

SEQ ID NO: 12214 - DNA, 847 bp, Artificial Sequence; identical to SEQ ID NO: 768
  Synthetic polypeptide

SEQ ID NO: 12215 - DNA, 665 bp, Artificial Sequence; identical to SEQ ID NO: 769
  Synthetic polypeptide

SEQ ID NO: 12216 - DNA, 826 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12217 - DNA, 826 bp, Artificial Sequence; identical to SEQ ID NO: 12209
  Synthetic polypeptide

SEQ ID NO: 12218 - DNA, 826 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12219 - DNA, 119 bp, Artificial Sequence; identical to SEQ ID NO: 6582
  Synthetic polypeptide

SEQ ID NO: 12220 - DNA, 826 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12221 - DNA, 826 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12222 - DNA, 1002 bp, Artificial Sequence; identical to SEQ ID NO: 872
  Synthetic polypeptide

SEQ ID NO: 12223 - DNA, 897 bp, Artificial Sequence; identical to SEQ ID NO: 873
  Synthetic polypeptide

SEQ ID NO: 12224 - DNA, 836 bp, Artificial Sequence; identical to SEQ ID NO: 874
  Synthetic polypeptide

SEQ ID NO: 12225 - DNA, 528 bp, Artificial Sequence; identical to SEQ ID NO: 875
  Synthetic polypeptide

SEQ ID NO: 12226 - DNA, 2003 bp, Artificial Sequence; identical to SEQ ID NO: 8385
  Synthetic polypeptide

SEQ ID NO: 12227 - DNA, 807 bp, Artificial Sequence; identical to SEQ ID NO: 7401
  Synthetic polypeptide

SEQ ID NO: 12228 - DNA, 453 bp, Artificial Sequence; identical to SEQ ID NO: 7402
  Synthetic polypeptide

SEQ ID NO: 12229 - DNA, 2725 bp, Artificial Sequence; identical to SEQ ID NO: 6753
  Synthetic polypeptide

SEQ ID NO: 12230 - DNA, 1164 bp, Artificial Sequence; identical to SEQ ID NO: 7133
  Synthetic polypeptide

SEQ ID NO: 12231 - DNA, 376 bp, Artificial Sequence; identical to SEQ ID NO: 7134
  Synthetic polypeptide

SEQ ID NO: 12232 - DNA, 745 bp, Artificial Sequence; identical to SEQ ID NO: 804
  Synthetic polypeptide

SEQ ID NO: 12233 - DNA, 1737 bp, Artificial Sequence; identical to SEQ ID NO: 905
  Synthetic polypeptide

SEQ ID NO: 12234 - DNA, 284 bp, Artificial Sequence; identical to SEQ ID NO: 906
  Synthetic polypeptide

SEQ ID NO: 12235 - DNA, 856 bp, Artificial Sequence; identical to SEQ ID NO: 907
  Synthetic polypeptide

SEQ ID NO: 12236 - DNA, 802 bp, Artificial Sequence; identical to SEQ ID NO: 908
  Synthetic polypeptide

SEQ ID NO: 12237 - DNA, 561 bp, Artificial Sequence; identical to SEQ ID NO: 909
  Synthetic polypeptide

SEQ ID NO: 12238 - DNA, 582 bp, Artificial Sequence; identical to SEQ ID NO: 910
  Synthetic polypeptide

SEQ ID NO: 12239 - DNA, 2025 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 12240 - DNA, 524 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtag

SEQ ID NO: 12241 - DNA, 536 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgt

SEQ ID NO: 12242 - DNA, 344 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactcaaaagcagacatgtgtcaatttaaattctacatctatgtatttggtaagcggaggcctaaataacactgt

SEQ ID NO: 12243 - DNA, 833 bp, Artificial Sequence
  Synthetic polypeptide
tgatatagttaggctttgtgtcgccacccaaatgtcatcttgaattgtaatccccataatccccaggtgttgatggagagatcaggtggaggtaactgaatcatgggggtgggtcccccatgttgttctcgtgatagcgagtgagttctcctgagatctgatggttttataaggagctcttccccgcttcacctggcacttcttcctgccaccttgtgaagaaggtgccttgcttcccggacctttggcttctaccacgattgtgagtttcctgaggcctccccgccatgctgaactacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtag

SEQ ID NO: 12244 - DNA, 3551 bp, Artificial Sequence; identical to SEQ ID NO: 9289
  Synthetic polypeptide

SEQ ID NO: 12245 - DNA, 3464 bp, Artificial Sequence; identical to SEQ ID NO: 9290
  Synthetic polypeptide

SEQ ID NO: 12246 - DNA, 3491 bp, Artificial Sequence; identical to SEQ ID NO: 9291
  Synthetic polypeptide

SEQ ID NO: 12247 - DNA, 1092 bp, Artificial Sequence; identical to SEQ ID NO: 9292
  Synthetic polypeptide

SEQ ID NO: 12248 - DNA, 1038 bp, Artificial Sequence; identical to SEQ ID NO: 9293
  Synthetic polypeptide

SEQ ID NO: 12249 - DNA, 3398 bp, Artificial Sequence; identical to SEQ ID NO: 9294
  Synthetic polypeptide

SEQ ID NO: 12250 - DNA, 3581 bp, Artificial Sequence; identical to SEQ ID NO: 9295
  Synthetic polypeptide

SEQ ID NO: 12251 - DNA, 2471 bp, Artificial Sequence; identical to SEQ ID NO: 576
  Synthetic polypeptide

SEQ ID NO: 12252 - DNA, 1072 bp, Artificial Sequence; identical to SEQ ID NO: 9520
  Synthetic polypeptide

SEQ ID NO: 12253 - DNA, 375 bp, Artificial Sequence; identical to SEQ ID NO: 7510
  Synthetic polypeptide

SEQ ID NO: 12254 - DNA, 683 bp, Artificial Sequence
  Synthetic polypeptide
aggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctag

SEQ ID NO: 12255 - DNA, 1795 bp, Artificial Sequence; identical to SEQ ID NO: 879
  Synthetic polypeptide

SEQ ID NO: 12256 - DNA, 1171 bp, Artificial Sequence; identical to SEQ ID NO: 880
  Synthetic polypeptide

SEQ ID NO: 12257 - DNA, 570 bp, Artificial Sequence; identical to SEQ ID NO: 9493
  Synthetic polypeptide

SEQ ID NO: 12258 - DNA, 513 bp, Artificial Sequence; identical to SEQ ID NO: 9494
  Synthetic polypeptide

SEQ ID NO: 12259 - DNA, 539 bp, Artificial Sequence; identical to SEQ ID NO: 9495
  Synthetic polypeptide

SEQ ID NO: 12260 - DNA, 144 bp, Artificial Sequence; identical to SEQ ID NO: 9496
  Synthetic polypeptide

SEQ ID NO: 12261 - DNA, 335 bp, Artificial Sequence
  Synthetic polypeptide
tcttctagagagatctagtaaaatattttatagatgatacaattggattctaaggttggtttcagaatcatcttggggagaagatgggcaggaatgtagtagagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12262 - DNA, 2317 bp, Artificial Sequence; identical to SEQ ID NO: 8404
  Synthetic polypeptide

SEQ ID NO: 12263 - DNA, 826 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 12264 - DNA, 826 bp, Artificial Sequence; identical to SEQ ID NO: 12263
  Synthetic polypeptide

SEQ ID NO: 12265 - DNA, 1093 bp, Artificial Sequence; identical to SEQ ID NO: 7796
  Synthetic polypeptide

SEQ ID NO: 12266 - DNA, 943 bp, Artificial Sequence; identical to SEQ ID NO: 6540
  Synthetic polypeptide

SEQ ID NO: 12267 - DNA, 625 bp, Artificial Sequence; identical to SEQ ID NO: 6804
  Synthetic polypeptide

SEQ ID NO: 12268 - DNA, 598 bp, Artificial Sequence; identical to SEQ ID NO: 6805
  Synthetic polypeptide

SEQ ID NO: 12269 - DNA, 1582 bp, Artificial Sequence; identical to SEQ ID NO: 7488
  Synthetic polypeptide

SEQ ID NO: 12270 - DNA, 1901 bp, Artificial Sequence; identical to SEQ ID NO: 7113
  Synthetic polypeptide

SEQ ID NO: 12271 - DNA, 1739 bp, Artificial Sequence; identical to SEQ ID NO: 7114
  Synthetic polypeptide

SEQ ID NO: 12272 - DNA, 1859 bp, Artificial Sequence; identical to SEQ ID NO: 7115
  Synthetic polypeptide

SEQ ID NO: 12273 - DNA, 1616 bp, Artificial Sequence; identical to SEQ ID NO: 7116
  Synthetic polypeptide

SEQ ID NO: 12274 - DNA, 501 bp, Artificial Sequence; identical to SEQ ID NO: 7117
  Synthetic polypeptide

SEQ ID NO: 12275 - DNA, 369 bp, Artificial Sequence; identical to SEQ ID NO: 7118
  Synthetic polypeptide

SEQ ID NO: 12276 - DNA, 2297 bp, Artificial Sequence; identical to SEQ ID NO: 7386
  Synthetic polypeptide

SEQ ID NO: 12277 - DNA, 2447 bp, Artificial Sequence; identical to SEQ ID NO: 7387
  Synthetic polypeptide

SEQ ID NO: 12278 - DNA, 2312 bp, Artificial Sequence; identical to SEQ ID NO: 7388
  Synthetic polypeptide

SEQ ID NO: 12279 - DNA, 2375 bp, Artificial Sequence; identical to SEQ ID NO: 7389
  Synthetic polypeptide

SEQ ID NO: 12280 - DNA, 2093 bp, Artificial Sequence; identical to SEQ ID NO: 7390
  Synthetic polypeptide

SEQ ID NO: 12281 - DNA, 2090 bp, Artificial Sequence; identical to SEQ ID NO: 7391
  Synthetic polypeptide

SEQ ID NO: 12282 - DNA, 1188 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctga

SEQ ID NO: 12283 - DNA, 1131 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataa

SEQ ID NO: 12284 - DNA, 1263 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggctcctgggcccccagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataa

SEQ ID NO: 12285 - DNA, 894 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtga

SEQ ID NO: 12286 - DNA, 807 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctga

SEQ ID NO: 12287 - DNA, 697 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtgg

SEQ ID NO: 12288 - DNA, 765 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctgggg

SEQ ID NO: 12289 - DNA, 365 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactggagtgggagttcgaggtgacagccttcta

SEQ ID NO: 12290 - DNA, 476 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaaccc

SEQ ID NO: 12291 - DNA, 113 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataa

SEQ ID NO: 12292 - DNA, 211 bp, Artificial Sequence
  Synthetic polypeptide
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacc

SEQ ID NO: 12293 - DNA, 308 bp, Artificial Sequence; identical to SEQ ID NO: 6645
  Synthetic polypeptide

SEQ ID NO: 12294 - DNA, 281 bp, Artificial Sequence; identical to SEQ ID NO: 6646
  Synthetic polypeptide

SEQ ID NO: 12295 - DNA, 359 bp, Artificial Sequence; identical to SEQ ID NO: 6647
  Synthetic polypeptide

SEQ ID NO: 12296 - DNA, 230 bp, Artificial Sequence; identical to SEQ ID NO: 6648
  Synthetic polypeptide

SEQ ID NO: 12297 - DNA, 112 bp, Artificial Sequence; identical to SEQ ID NO: 7120
  Synthetic polypeptide

SEQ ID NO: 12298 - DNA, 1213 bp, Artificial Sequence
  Synthetic polypeptide
cctcccctgcaagcctggcctgcatgatatacttaacaatctgagatcaaaatatgccaagcaaataaagcagtttcaggaggagaaccagtctctaacctcggactacaaacgtcttgtgatgcaattcaaggagctacagaaagccatgaggcattttgctcttattgatgatgagaagttttgggagatttggctgatgaatgaagaggaggcgaaggacctaatagccagagcctttgatgtggacaggatcatccacacccatcatctggggcttccctgggcagcacctgatttctggttcctgaacaatgttgggcctatttctcagcagccccagaagtccgccacacagatagtagaagaaatgcttatgcgctcagaagaggaggaggcagaagaggccgccgcggaaccagagtcctacctggatttgccgaagcaaatttctgaaaaaactaccaagaggatcctgatgctcctgtgtgacgagtcggggttcctcatagagagcaagctgctgagccttctcctgcccctggagcagaatgaatgctatctgctgaggctggatgccatcttctccgcccttggaattgaaagtgaggatgacttgtataaactggtgaacttcttccttaaatatcgagctcaccgtttatcttccagcctccagatcaagccctgcagtcaggcgagcatggagaaggcgagcatggaggagacaagcacgaggtcagaattggagctggcagagcagacggagatggagggagaaaaggaagaaagcctggtggaaggggagaaggaagaagaggaggagaccccaccctccccctgggtcatccaccccaatgatgtcctcaagattctggaggccttcgtcatgggtctgaagaagcctagggactcgcgggccccgctgagggtacagaagaatgtgcgtgacaactccaaggactcggagtactggcaggccctgaccacagtgatcccttcctccaagcagaacctctgggatgccctctacacagccttggagaagtaccaccttgtcctgacccagagggccaagctgctgctggaaaacagttctctggagcagcagaacacagagctgcaggcgctactgcagcagtatctgaactccaagatcaactctgaactgcaagttcctcccactcaggtgttgcgggtacccacaaaatga

SEQ ID NO: 12299 - DNA, 55 bp, Artificial Sequence
  Synthetic polypeptide
cctcccctgcaagcctggcctgcatgatatacttaacaatctgagatcaaaatat

SEQ ID NO: 12300 - DNA, 772 bp, Artificial Sequence; identical to SEQ ID NO: 7475
  Synthetic polypeptide

SEQ ID NO: 12301 - DNA, 832 bp, Artificial Sequence; identical to SEQ ID NO: 7476
  Synthetic polypeptide

SEQ ID NO: 12302 - DNA, 763 bp, Artificial Sequence; identical to SEQ ID NO: 7477
  Synthetic polypeptide

SEQ ID NO: 12303 - DNA, 1043 bp, Artificial Sequence; identical to SEQ ID NO: 8639
  Synthetic polypeptide

SEQ ID NO: 12304 - DNA, 366 bp, Artificial Sequence; identical to SEQ ID NO: 8640
  Synthetic polypeptide

SEQ ID NO: 12305 - DNA, 913 bp, Artificial Sequence; identical to SEQ ID NO: 8351
  Synthetic polypeptide

SEQ ID NO: 12306 - DNA, 718 bp, Artificial Sequence; identical to SEQ ID NO: 8352
  Synthetic polypeptide

SEQ ID NO: 12307 - DNA, 835 bp, Artificial Sequence; identical to SEQ ID NO: 6764
  Synthetic polypeptide

SEQ ID NO: 12308 - DNA, 3882 bp, Artificial Sequence; identical to SEQ ID NO: 8381
  Synthetic polypeptide

SEQ ID NO: 12309 - DNA, 4011 bp, Artificial Sequence; identical to SEQ ID NO: 8382
  Synthetic polypeptide

SEQ ID NO: 12310 - DNA, 1060 bp, Artificial Sequence; identical to SEQ ID NO: 8383
  Synthetic polypeptide

SEQ ID NO: 12311 - DNA, 2346 bp, Artificial Sequence; identical to SEQ ID NO: 9066
  Synthetic polypeptide

SEQ ID NO: 12312 - DNA, 739 bp, Artificial Sequence; identical to SEQ ID NO: 8416
  Synthetic polypeptide

SEQ ID NO: 12313 - DNA, 2774 bp, Artificial Sequence
  Synthetic polypeptide
ggccaagcattgtggcacacgcctgtaatctcattacactgggaggctgtggcagaaggatcgcttgaggccaggagtttgagactagcctacgtaacatgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtga

SEQ ID NO: 12314 - DNA, 654 bp, Artificial Sequence
  Synthetic polypeptide
ggccaagcattgtggcacacgcctgtaatctcattacactgggaggctgtggcagaaggatcgcttgaggccaggagtttgagactagcctacgtaacatgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctg

SEQ ID NO: 12315 - DNA, 2293 bp, Artificial Sequence; identical to SEQ ID NO: 9491
  Synthetic polypeptide

SEQ ID NO: 12316 - DNA, 2148 bp, Artificial Sequence; identical to SEQ ID NO: 8357
  Synthetic polypeptide

SEQ ID NO: 12317 - DNA, 2019 bp, Artificial Sequence; identical to SEQ ID NO: 8358
  Synthetic polypeptide

SEQ ID NO: 12318 - DNA, 2825 bp, Artificial Sequence; identical to SEQ ID NO: 6727
  Synthetic polypeptide

SEQ ID NO: 12319 - DNA, 316 bp, Artificial Sequence; identical to SEQ ID NO: 6961
  Synthetic polypeptide

SEQ ID NO: 12320 - DNA, 476 bp, Artificial Sequence; identical to SEQ ID NO: 6601
  Synthetic polypeptide

SEQ ID NO: 12321 - DNA, 461 bp, Artificial Sequence; identical to SEQ ID NO: 6602
  Synthetic polypeptide

SEQ ID NO: 12322 - DNA, 361 bp, Artificial Sequence; identical to SEQ ID NO: 6603
  Synthetic polypeptide

SEQ ID NO: 12323 - DNA, 701 bp, Artificial Sequence; identical to SEQ ID NO: 658
  Synthetic polypeptide

SEQ ID NO: 12324 - DNA, 656 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12325 - DNA, 286 bp, Artificial Sequence
  Synthetic polypeptide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtggaatgtcatccttacttcaaccagagaaa

SEQ ID NO: 12326 - DNA, 964 bp, Artificial Sequence
  Synthetic polypeptide
tgatatggtttggctgtgtgcccatcgaaatctcatcttgaattgtagctgccattattcccacgtgttgtgggagggacccagtgggagacaattgaatcatgggggcagtttccctcatactgttctggtggtagtgaataagtctcacgagatctgatggttttataaggggaaacccctttcacttggttcctattctctcttgcctgccgctgcataagacatgatatttgccttctgccatgattgtgaggcctccccagccacataaaaccgagatgatggtgaaaaaggagatccaggagaagagggaaagcatggcaaagtgggacgcatggggccgaaaggaattaaaggagaactgggtgatatgggagatcagggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgctcggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaa

SEQ ID NO: 12327 - DNA, 428 bp, Artificial Sequence; identical to SEQ ID NO: 7041
  Synthetic polypeptide

SEQ ID NO: 12328 - DNA, 435 bp, Artificial Sequence; identical to SEQ ID NO: 7042
  Synthetic polypeptide

SEQ ID NO: 12329 - DNA, 3591 bp, Artificial Sequence; identical to SEQ ID NO: 8632
  Synthetic polypeptide

SEQ ID NO: 12330 - DNA, 3504 bp, Artificial Sequence; identical to SEQ ID NO: 8633
  Synthetic polypeptide

SEQ ID NO: 12331 - DNA, 3531 bp, Artificial Sequence; identical to SEQ ID NO: 8634
  Synthetic polypeptide

SEQ ID NO: 12332 - DNA, 1132 bp, Artificial Sequence; identical to SEQ ID NO: 8635
  Synthetic polypeptide

SEQ ID NO: 12333 - DNA, 1078 bp, Artificial Sequence; identical to SEQ ID NO: 8636
  Synthetic polypeptide

SEQ ID NO: 12334 - DNA, 3438 bp, Artificial Sequence; identical to SEQ ID NO: 8637
  Synthetic polypeptide

SEQ ID NO: 12335 - DNA, 3621 bp, Artificial Sequence; identical to SEQ ID NO: 8638
  Synthetic polypeptide

SEQ ID NO: 12336 - DNA, 224 bp, Artificial Sequence
  Synthetic polypeptide
gccgggcatggtggctcacacctgtaatcccagcactttgggaggccgaggccgacggatcgcttgagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatag

SEQ ID NO: 12337 - DNA, 1224 bp, Artificial Sequence; identical to SEQ ID NO: 6690
  Synthetic polypeptide

SEQ ID NO: 12338 - DNA, 370 bp, Artificial Sequence; identical to SEQ ID NO: 6522
  Synthetic polypeptide

SEQ ID NO: 12339 - DNA, 181 bp, Artificial Sequence
  Synthetic polypeptide
ggccaggcacagtggctcacgcctgtaaccccagcgctttgggatgccatggcaggatcatttgaggccaggttctgaagacagcccacccaagcatgcaggcaacaacgaaagccattcttccaggagaaggaatcggcattccaagtcaaaagtcaccaatggcgttggaaagaaatga

SEQ ID NO: 12340 - DNA, 274 bp, Artificial Sequence
  Synthetic polypeptide
ggccaggcacagtggctcacgcctgtaaccccagcgctttgggatgccatggcaggatcatttgaggccaggttctgaagacagcccacccaagcatgcaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtag

SEQ ID NO: 12341 - DNA, 400 bp, Artificial Sequence; identical to SEQ ID NO: 749
  Synthetic polypeptide

SEQ ID NO: 12342 - DNA, 2301 bp, Artificial Sequence; identical to SEQ ID NO: 750
  Synthetic polypeptide

SEQ ID NO: 12343 - DNA, 2381 bp, Artificial Sequence; identical to SEQ ID NO: 751
  Synthetic polypeptide

SEQ ID NO: 12344 - DNA, 692 bp, Artificial Sequence; identical to SEQ ID NO: 752
  Synthetic polypeptide

SEQ ID NO: 12345 - DNA, 210 bp, Artificial Sequence
  Synthetic polypeptide
ggccaggtgcggtggctcacggctgtaatcccagcactttgggaggccgaggcaggcagatcacctgaggtcgatagtttgagaccagcttggccaacacgggtgatcgtcttggacaaaggagaaatccaggagtacggcgccccatcggacctcctgcagcagagaggtcttttctacagcatggccaaagacgccggcttggtgtga

SEQ ID NO: 12346 - DNA, 693 bp, Artificial Sequence
  Synthetic polypeptide
caacatagagatgatggtgaaaaaggagatccaggagaagagggaaagcatggcaaagtgggacgcatggggccgaaaggaattaaaggagaactgggtgatatgggagatcagggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgctcggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaa

SEQ ID NO: 12347 - DNA, 504 bp, Artificial Sequence; identical to SEQ ID NO: 7011
  Synthetic polypeptide

SEQ ID NO: 12348 - DNA, 2153 bp, Artificial Sequence; identical to SEQ ID NO: 7012
  Synthetic polypeptide

SEQ ID NO: 12349 - DNA, 818 bp, Artificial Sequence; identical to SEQ ID NO: 7013
  Synthetic polypeptide

SEQ ID NO: 12350 - DNA, 750 bp, Artificial Sequence; identical to SEQ ID NO: 489
  Synthetic polypeptide

SEQ ID NO: 12351 - DNA, 1007 bp, Artificial Sequence; identical to SEQ ID NO: 7489
  Synthetic polypeptide

SEQ ID NO: 12352 - DNA, 586 bp, Artificial Sequence; identical to SEQ ID NO: 6809
  Synthetic polypeptide

SEQ ID NO: 12353 - DNA, 1072 bp, Artificial Sequence; identical to SEQ ID NO: 9526
  Synthetic polypeptide

SEQ ID NO: 12354 - DNA, 847 bp, Artificial Sequence
  Synthetic polypeptide
ccttgctcctcaaagtacagcatgtggactcgcagccctcattaaaaccaggaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattga

SEQ ID NO: 12355 - DNA, 610 bp, Artificial Sequence
  Synthetic polypeptide
ccttgctcctcaaagtacagcatgtggactcgcagccctcattaaaaccaggaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgaatgggtaa

SEQ ID NO: 12356 - DNA, 532 bp, Artificial Sequence
  Synthetic polypeptide
ccttgctcctcaaagtacagcatgtggactcgcagccctcattaaaaccaggaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcatgcttacgttaagacaaggagactgcaaaatgactgatgtccaagcagcatga

SEQ ID NO: 12357 - DNA, 455 bp, Artificial Sequence
  Synthetic polypeptide
tgttatggtttggatttgtgtccctgcccaaatctcatgtcgaattgtaatccccagtgtgggaggaggggcctggtgggaggtgattggatcatggagacagatttcttctttgctgttctcatgatagtgagtaagttctcatgagatctgggtttctaaaaagtgtgtggcaccttccccttctctttctcctgctctggccatgtaagacatacctccttcctctttgccttccaccatgattgtatatttcctgagacctctccagccatgcttcccgtacagccttggccttgctaacaagtttacctccaaactatgagatttcagaaggaaaaccaagagccatctctgcatatgtgagagcgggcaaaggaaatgtgacaaggagaagaaagaagacacacttgggcaatgatgatgggaagaaggaagcacaggagaaaatgtaa

SEQ ID NO: 12358 - DNA, 970 bp, Artificial Sequence; identical to SEQ ID NO: 711
  Synthetic polypeptide

SEQ ID NO: 12359 - DNA, 1181 bp, Artificial Sequence; identical to SEQ ID NO: 9640
  Synthetic polypeptide

SEQ ID NO: 12360 - DNA, 1061 bp, Artificial Sequence; identical to SEQ ID NO: 9641
  Synthetic polypeptide

SEQ ID NO: 12361 - DNA, 851 bp, Artificial Sequence; identical to SEQ ID NO: 9642
  Synthetic polypeptide

SEQ ID NO: 12362 - DNA, 818 bp, Artificial Sequence; identical to SEQ ID NO: 9643
  Synthetic polypeptide

SEQ ID NO: 12363 - DNA, 847 bp, Artificial Sequence; identical to SEQ ID NO: 9644
  Synthetic polypeptide

SEQ ID NO: 12364 - DNA, 2165 bp, Artificial Sequence; identical to SEQ ID NO: 9527
  Synthetic polypeptide

SEQ ID NO: 12365 - DNA, 247 bp, Artificial Sequence
  Synthetic polypeptide
ggcctcagggacccaggccccatgtggcaagctggccagtgttccctgcaatgcatctacggagtcttccccacccctggccaagggctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12366 - DNA, 119 bp, Artificial Sequence
  Synthetic polypeptide
ggcctcagggacccaggccccatgtggcaagctggccagtgttccctgcaatgcatctacggagtcttccccacccctggccaagggctacaatgagcagcgcatcagacagaacgtgc

SEQ ID NO: 12367 - DNA, 597 bp, Artificial Sequence; identical to SEQ ID NO: 759
  Synthetic polypeptide

SEQ ID NO: 12368 - DNA, 654 bp, Artificial Sequence; identical to SEQ ID NO: 760
  Synthetic polypeptide

SEQ ID NO: 12369 - DNA, 1358 bp, Artificial Sequence
  Synthetic polypeptide
ggctgggtgtggtggcttatgcactaatcccagcactttgggaggctaaagcaggagggttacttgagaccaggagtttaacaccagcctaggcaacataaggagaccctgtatctatgaaacataatgtaccattgagcatggtggtgcatgtctgtgctactcgggaggctgaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 12370 - DNA, 1478 bp, Artificial Sequence
  Synthetic polypeptide
ggctgggtgtggtggcttatgcactaatcccagcactttgggaggctaaagcaggagggttacttgagaccaggagtttaacaccagcctaggcaacataaggagaccctgtatctatgaaacataatgtaccattgagcatggtggtgcatgtctgtgctactcgggaggctgaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 12371 - DNA, 696 bp, Artificial Sequence; identical to SEQ ID NO: 6897
  Synthetic polypeptide

SEQ ID NO: 12372 - DNA, 801 bp, Artificial Sequence; identical to SEQ ID NO: 6898
  Synthetic polypeptide

SEQ ID NO: 12373 - DNA, 594 bp, Artificial Sequence; identical to SEQ ID NO: 9569
  Synthetic polypeptide

SEQ ID NO: 12374 - DNA, 1757 bp, Artificial Sequence; identical to SEQ ID NO: 9401
  Synthetic polypeptide

SEQ ID NO: 12375 - DNA, 950 bp, Artificial Sequence; identical to SEQ ID NO: 9402
  Synthetic polypeptide

SEQ ID NO: 12376 - DNA, 1259 bp, Artificial Sequence; identical to SEQ ID NO: 9403
  Synthetic polypeptide

SEQ ID NO: 12377 - DNA, 677 bp, Artificial Sequence; identical to SEQ ID NO: 747
  Synthetic polypeptide

SEQ ID NO: 12378 - DNA, 674 bp, Artificial Sequence; identical to SEQ ID NO: 748
  Synthetic polypeptide

SEQ ID NO: 12379 - DNA, 394 bp, Artificial Sequence; identical to SEQ ID NO: 701
  Synthetic polypeptide

SEQ ID NO: 12380 - DNA, 700 bp, Artificial Sequence; identical to SEQ ID NO: 702
  Synthetic polypeptide

SEQ ID NO: 12381 - DNA, 568 bp, Artificial Sequence; identical to SEQ ID NO: 703
  Synthetic polypeptide

SEQ ID NO: 12382 - DNA, 535 bp, Artificial Sequence; identical to SEQ ID NO: 704
  Synthetic polypeptide

SEQ ID NO: 12383 - DNA, 129 bp, Artificial Sequence; identical to SEQ ID NO: 705
  Synthetic polypeptide

SEQ ID NO: 12384 - DNA, 435 bp, Artificial Sequence; identical to SEQ ID NO: 706
  Synthetic polypeptide

SEQ ID NO: 12385 - DNA, 303 bp, Artificial Sequence; identical to SEQ ID NO: 707
  Synthetic polypeptide

SEQ ID NO: 12386 - DNA, 270 bp, Artificial Sequence; identical to SEQ ID NO: 708
  Synthetic polypeptide

SEQ ID NO: 12387 - DNA, 2201 bp, Artificial Sequence
  Synthetic polypeptide
agagcactgtcgtgggcagcaggcagacctgagtccaagtgtggctccaccactcactagctgtgtgaccttgggcaagccccttacctctctgagcgtgtacctgctcatcagctaaagcaggggtcataccaaatccttctgccttacagggctgttgtgaggattaccgagtgcctagcacagtgcctggcctgcacttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggctttgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggacggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaa

SEQ ID NO: 12388 - DNA, 629 bp, Artificial Sequence
  Synthetic polypeptide
agagcactgtcgtgggcagcaggcagacctgagtccaagtgtggctccaccactcactagctgtgtgaccttgggcaagccccttacctctctgagcgtgtacctgctcatcagctaaagcaggggtcataccaaatccttctgccttacagggctgttgtgaggattaccgagtgcctagcacagtgcctggcctgcacttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggctttgagcataagatcacagtccaggcctctccaactctggataagcggaaaggatccgatggggccagcccccctgcaagccccagcatcatcccccggctga

SEQ ID NO: 12389 - DNA, 578 bp, Artificial Sequence
  Synthetic polypeptide
ggttcaaatcccaggtggtctaccatgtactaatcacccaagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtag

SEQ ID NO: 12390 - DNA, 1779 bp, Artificial Sequence
  Synthetic polypeptide
aaaataaataattgggacataattaaagtaaaaagcttctgcacagcaaaaataataataataatcacagtaaacagacaacctgtagggagaaaatatttgcaaactatgcatctgacaaaggactaatacccagaatctacaaggaactcaaacaaatcagcaagaaaaaaaaatcaaataatctcatcaaaaagtgggcaaatgacctaaatagaattttctcaaaagaagatatggccaacaaacatatgaaaaaatgctcaatgtcactaatcatcagggaaatgcaaattaaaaccacaatgagataccaccttactccagccagaatggccattactaaaaagtcaaagaacaatagatgttggcatggatgtgatgaaaagggaatacttaaacactgctggtgggaatgtaatttagtacaaccactgtagaaaccactgggtatctatccaaaggaagagaagtcattatataaaaagacacctgtatatgtatgtttatcgcagcacatttcacaattgcaaagatagggaaccaacctaagtgtcagctgatgagtggataaagcaaatttgatatatatacatcatgaaatactccccagccattaaaaaaagaatgaaataatatcttttgcagcaacgtggaaggaaccagaggctgttattctaagtgaagtaactctggaatggaaaaccaagtaccaggtcgtctcgcttacaagaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaa

SEQ ID NO: 12391 - DNA, 810 bp, Artificial Sequence
  Synthetic polypeptide
aaaataaataattgggacataattaaagtaaaaagcttctgcacagcaaaaataataataataatcacagtaaacagacaacctgtagggagaaaatatttgcaaactatgcatctgacaaaggactaatacccagaatctacaaggaactcaaacaaatcagcaagaaaaaaaaatcaaataatctcatcaaaaagtgggcaaatgacctaaatagaattttctcaaaagaagatatggccaacaaacatatgaaaaaatgctcaatgtcactaatcatcagggaaatgcaaattaaaaccacaatgagataccaccttactccagccagaatggccattactaaaaagtcaaagaacaatagatgttggcatggatgtgatgaaaagggaatacttaaacactgctggtgggaatgtaatttagtacaaccactgtagaaaccactgggtatctatccaaaggaagagaagtcattatataaaaagacacctgtatatgtatgtttatcgcagcacatttcacaattgcaaagatagggaaccaacctaagtgtcagctgatgagtggataaagcaaatttgatatatatacatcatgaaatactccccagccattaaaaaaagaatgaaataatatcttttgcagcaacgtggaaggaaccagaggctgttattctaagtgaagtaactctggaatggaaaaccaagtaccaggtcgtctcgcttacaagaatgttttaaaggaagttgggctactcacaagttactacataagaaagcaaagagaaggtgttatgtaatgtcttaa

SEQ ID NO: 12392 - DNA, 766 bp, Artificial Sequence
  Synthetic polypeptide
tgatatgatttggctctgtatctctacccaaatctcatctcaaattgtaattcccatgtgtcaaggagggacctggtgggaggtgattggataatgggagtggtttcccccatgctgttcttgtgatagtgagttctcatgagatctgatagtttaaaagtggctcttcctcctttgttctctcttttctcccaccccgcgaagagggtgcttgctttccctttgctttctgccataattacaagtttcctgagtcctcgccagccatgtggaactgcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtag

SEQ ID NO: 12393 - DNA, 2267 bp, Artificial Sequence
  Synthetic polypeptide
tgatatgatttggctctgtatctctacccaaatctcatctcaaattgtaattcccatgtgtcaaggagggacctggtgggaggtgattggataatgggagtggtttcccccatgctgttcttgtgatagtgagttctcatgagatctgatagtttaaaagtggctcttcctcctttgttctctcttttctcccaccccgcgaagagggtgcttgctttccctttgctttctgccataattacaagtttcctgagtcctcgccagccatgtggaactgcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 12394 - DNA, 1346 bp, Artificial Sequence; identical to SEQ ID NO: 7758
  Synthetic polypeptide

SEQ ID NO: 12395 - DNA, 243 bp, Artificial Sequence
  Synthetic polypeptide
ggccaggcacggtggctcacgcctgtaatcccagcactttgggaggccgagacgggcggatcacgaggtcaagagatggagaccatcccggctaacacggaagatattcttgatactggaaatgacaaaaatggaaaggaagaagtcataaagagaaaaattccttatattctgaaacggcagctgtatgagaataaacccagaagaccctacatactcaaaagagattcttactattactga

SEQ ID NO: 12396 - DNA, 367 bp, Artificial Sequence
  Synthetic polypeptide
ggctgggtgcggtggctcatgcctgtaatcccagcactttgggaggccgacggatcacttgaggtcaggagttcaagaccagcctggccagcgtgttgaaaccctgcctctactaaaaatacaaaagttagctgggcatggtggtgggcgcctgtaatcccaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttag

SEQ ID NO: 12397 - DNA, 882 bp, Artificial Sequence; identical to SEQ ID NO: 9355
  Synthetic polypeptide

SEQ ID NO: 12398 - DNA, 1579 bp, Artificial Sequence; identical to SEQ ID NO: 7461
  Synthetic polypeptide

SEQ ID NO: 12399 - DNA, 1504 bp, Artificial Sequence; identical to SEQ ID NO: 7462
  Synthetic polypeptide

SEQ ID NO: 12400 - DNA, 353 bp, Artificial Sequence; identical to SEQ ID NO: 7197
  Synthetic polypeptide

SEQ ID NO: 12401 - DNA, 121 bp, Artificial Sequence; identical to SEQ ID NO: 7198
  Synthetic polypeptide

SEQ ID NO: 12402 - DNA, 826 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12403 - DNA, 718 bp, Artificial Sequence
  Synthetic polypeptide
ggctacctacaaagggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 12404 - DNA, 616 bp, Artificial Sequence
  Synthetic polypeptide
ggctacctacaaagggctcctggtgcagcagatcatcttcttcctgggaaccacggccctggccttcctggtgctcatgcctgtgctccatggcaggaacctcctgctcttccgttccctggagtcctcgtgaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcaca

SEQ ID NO: 12405 - DNA, 326 bp, Artificial Sequence
  Synthetic polypeptide
aatgtgttgtaatggggaaagctttagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtga

SEQ ID NO: 12406 - DNA, 482 bp, Artificial Sequence
  Synthetic polypeptide
aatgtgttgtaatggggaaagctttagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcatagagacggggtttcaccgcattggtcagggtggtcacgaactcctgacgtccagtaatccacccgcctcagcctcccaaagtgctgggattacaggtgtgagccactgtgcccagctgcaaacagtctttatgtgggtatcaatgtcagtctcaccattgctcataagtggtgagagtaagagcaatgctccattttcttcttga

SEQ ID NO: 12407 - DNA, 238 bp, Artificial Sequence
  Synthetic polypeptide
cttccagccaagatggagtaacagagattagatttatgcttctacttgaaacaaccaagaaaactcagttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctga

SEQ ID NO: 12408 - DNA, 1389 bp, Artificial Sequence; identical to SEQ ID NO: 863
  Synthetic polypeptide

SEQ ID NO: 12409 - DNA, 205 bp, Artificial Sequence
  Synthetic polypeptide
aagacggccgaataggaacagctccggtctacagctcccagcgtgagcaatgcagaagaccggtgatttctgcatttccatctgagtgtgtatgtacagagaaccatcgctacatgaaattggagaaaaacaagggcgttcaaggaaaagttctggaacaccaaccatgaatggaggcaaagttgtgaatcaagattcaacatag

SEQ ID NO: 12410 - DNA, 154 bp, Artificial Sequence
  Synthetic polypeptide
aagacggccgaataggaacagctccggtctacagctcccagcgtgagcaatgcagaagaccggtgatttctgcatttccatctgagtgtgtatgtacagagaaccatcgctacatgaaattggagaaaaacaagggcgttcaaggaaaagttct

SEQ ID NO: 12411 - DNA, 826 bp, Artificial Sequence; identical to SEQ ID NO: 12216
  Synthetic polypeptide

SEQ ID NO: 12412 - DNA, 960 bp, Artificial Sequence; identical to SEQ ID NO: 7275
  Synthetic polypeptide

SEQ ID NO: 12413 - DNA, 826 bp, Artificial Sequence; identical to SEQ ID NO: 12402
  Synthetic polypeptide

SEQ ID NO: 12414 - DNA, 3380 bp, Artificial Sequence
  Synthetic polypeptide
tgaaatttccataaaaacccaggaggactaggttccagaagcttcaggatggctcaacacgtggaggttcttggagggtggcctgcacaggaagggcatagaagccctgtgccccttcccccatacctcactctgtgcatctctttatctgtaatatcctttacaataaaccagtaaatgtaagtgtttcccaaagttctgtgagccctccagcaaattaatcaaacccaaagaggaggtcgtgggaaccccaacttgaaagccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 12415 - DNA, 3584 bp, Artificial Sequence
  Synthetic polypeptide
tgaaatttccataaaaacccaggaggactaggttccagaagcttcaggatggctcaacacgtggaggttcttggagggtggcctgcacaggaagggcatagaagccctgtgccccttcccccatacctcactctgtgcatctctttatctgtaatatcctttacaataaaccagtaaatgtaagtgtttcccaaagttctgtgagccctccagcaaattaatcaaacccaaagaggaggtcgtgggaaccccaacttgaaagccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 12416 - DNA, 581 bp, Artificial Sequence
  Synthetic polypeptide
acttaacacccattagaatggccactatcaaaaaaacagagaatgacacatgttggcaaggatactgaaaaattggaacccttgtgcattgttggtgtgaatgtaaaatggtacaactgctatttaaaaatagtatggaggtttctcaaaaaatgctcaaaaaagagaactacgatattatccagcaattccacctcaggatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctga

SEQ ID NO: 12417 - DNA, 455 bp, Artificial Sequence; identical to SEQ ID NO: 7734
  Synthetic polypeptide

SEQ ID NO: 12418 - DNA, 771 bp, Artificial Sequence; identical to SEQ ID NO: 8620
  Synthetic polypeptide

SEQ ID NO: 12419 - DNA, 720 bp, Artificial Sequence; identical to SEQ ID NO: 8621
  Synthetic polypeptide

SEQ ID NO: 12420 - DNA, 464 bp, Artificial Sequence; identical to SEQ ID NO: 8622
  Synthetic polypeptide

SEQ ID NO: 12421 - DNA, 607 bp, Artificial Sequence; identical to SEQ ID NO: 9998
  Synthetic polypeptide

SEQ ID NO: 12422 - DNA, 225 bp, Artificial Sequence; identical to SEQ ID NO: 7100
  Synthetic polypeptide

SEQ ID NO: 12423 - DNA, 1731 bp, Artificial Sequence; identical to SEQ ID NO: 6691
  Synthetic polypeptide

SEQ ID NO: 12424 - DNA, 2019 bp, Artificial Sequence; identical to SEQ ID NO: 6692
  Synthetic polypeptide

SEQ ID NO: 12425 - DNA, 2043 bp, Artificial Sequence; identical to SEQ ID NO: 6693
  Synthetic polypeptide

SEQ ID NO: 12426 - DNA, 554 bp, Artificial Sequence; identical to SEQ ID NO: 6694
  Synthetic polypeptide

SEQ ID NO: 12427 - DNA, 281 bp, Artificial Sequence; identical to SEQ ID NO: 9447
  Synthetic polypeptide

SEQ ID NO: 12428 - DNA, 990 bp, Artificial Sequence; identical to SEQ ID NO: 9448
  Synthetic polypeptide

SEQ ID NO: 12429 - DNA, 338 bp, Artificial Sequence; identical to SEQ ID NO: 9449
  Synthetic polypeptide

SEQ ID NO: 12430 - DNA, 367 bp, Artificial Sequence; identical to SEQ ID NO: 9450
  Synthetic polypeptide

SEQ ID NO: 12431 - DNA, 197 bp, Artificial Sequence; identical to SEQ ID NO: 9451
  Synthetic polypeptide

SEQ ID NO: 12432 - DNA, 813 bp, Artificial Sequence; identical to SEQ ID NO: 9452
  Synthetic polypeptide

SEQ ID NO: 12433 - DNA, 583 bp, Artificial Sequence; identical to SEQ ID NO: 9453
  Synthetic polypeptide

SEQ ID NO: 12434 - DNA, 795 bp, Artificial Sequence; identical to SEQ ID NO: 9454
  Synthetic polypeptide

SEQ ID NO: 12435 - DNA, 588 bp, Artificial Sequence; identical to SEQ ID NO: 9455
  Synthetic polypeptide

SEQ ID NO: 12436 - DNA, 379 bp, Artificial Sequence; identical to SEQ ID NO: 9456
  Synthetic polypeptide

SEQ ID NO: 12437 - DNA, 2271 bp, Artificial Sequence; identical to SEQ ID NO: 8631
  Synthetic polypeptide

SEQ ID NO: 12438 - DNA, 814 bp, Artificial Sequence; identical to SEQ ID NO: 8476
  Synthetic polypeptide

SEQ ID NO: 12439 - DNA, 1348 bp, Artificial Sequence; identical to SEQ ID NO: 8477
  Synthetic polypeptide

SEQ ID NO: 12440 - DNA, 780 bp, Artificial Sequence; identical to SEQ ID NO: 9512
  Synthetic polypeptide

SEQ ID NO: 12441 - DNA, 606 bp, Artificial Sequence; identical to SEQ ID NO: 9513
  Synthetic polypeptide

SEQ ID NO: 12442 - DNA, 523 bp, Artificial Sequence
  Synthetic polypeptide
tgatatggtttggctgtgttcccacccaaatctcatcctgaattgtagttcccataatccccacatgtcgtgggagggacccagagggaggtaattggaccttgggggtggctttccccattctattgtcatggtattgagtaagttctcacgagagctgatggttttataaggggcttcccccttcactcagctctcattcttttccctcctgccaccatgtgaagaaggacatgcttgctttctcttctgccatgattgtaagtttcctgaggcctccccagccctgcagaacactactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtga

SEQ ID NO: 12443 - DNA, 398 bp, Artificial Sequence; identical to SEQ ID NO: 6790
  Synthetic polypeptide

SEQ ID NO: 12444 - DNA, 391 bp, Artificial Sequence; identical to SEQ ID NO: 6791
  Synthetic polypeptide

SEQ ID NO: 12445 - DNA, 473 bp, Artificial Sequence; identical to SEQ ID NO: 6792
  Synthetic polypeptide

SEQ ID NO: 12446 - DNA, 622 bp, Artificial Sequence
  Synthetic polypeptide
ccagggggaattttagaaaatgtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattga

SEQ ID NO: 12447 - DNA, 384 bp, Artificial Sequence; identical to SEQ ID NO: 8641
  Synthetic polypeptide

SEQ ID NO: 12448 - DNA, 345 bp, Artificial Sequence; identical to SEQ ID NO: 8642
  Synthetic polypeptide

SEQ ID NO: 12449 - DNA, 474 bp, Artificial Sequence
  Synthetic polypeptide
gaccaggcatggtggctcacacctgaaatcccagcactttgggaggccaaagcagaaggatcgcttgagcccaggagttcaggaccagcctgggcaacatagcaagaccctgtctctacagaaaaacacacacacagaaaaattagccgggcatgggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctag

SEQ ID NO: 12450 - DNA, 878 bp, Artificial Sequence
  Synthetic polypeptide
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaa

SEQ ID NO: 12451 - DNA, 168 bp, Artificial Sequence
  Synthetic polypeptide
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttc

SEQ ID NO: 12452 - DNA, 758 bp, Artificial Sequence
  Synthetic polypeptide
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaa

SEQ ID NO: 12453 - DNA, 366 bp, Artificial Sequence
  Synthetic polypeptide
agattggagagaaaagcctgtttaccaaggagcttgaacatgccctggagaagaatgagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagg

SEQ ID NO: 12454 - DNA, 839 bp, Artificial Sequence
  Synthetic polypeptide
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaa

SEQ ID NO: 12455 - DNA, 404 bp, Artificial Sequence
  Synthetic polypeptide
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcag

SEQ ID NO: 12456 - DNA, 389 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctgatctcatagagtctggccagcttcgagaaagagttgagaagttaaacatgctcagcattgatcatctcacagaccacaagtcacagcgcctt

SEQ ID NO: 12457 - DNA, 695 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagta

SEQ ID NO: 12458 - DNA, 1367 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaa

SEQ ID NO: 12459 - DNA, 297 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctg

SEQ ID NO: 12460 - DNA, 668 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagtatgtaaacagaacatggacgttttgttctcatttcgtgatggagactgcagtaaaggattcttcctggtctctctattggtggaaatag

SEQ ID NO: 12461 - DNA, 258 bp, Artificial Sequence
  Synthetic polypeptide
ggccaggttcggtggcttatacctgtaatcccagcactttgggaggccaagttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctag

SEQ ID NO: 12462 - DNA, 570 bp, Artificial Sequence
  Synthetic polypeptide
ggccaggttcggtggcttatacctgtaatcccagcactttgggaggccaagttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcagtttagaaaacgctaaaccctcctcccaggcagcctccgtcacgatccctgatcacctcagcatcaacctctctcaaccctccaccccttcttcttcttcctcctccaccaccaccccctcgctcgccacagcggggacctccgacgcaccctccagcctccccaaccctcttccgaccgccccttgtgtctccagtctgcttggcatgaaacccatccctctcctggctctaaatgttgtgtctgctgctaagggtaccggggcttcagctaccaccaccaccacctctgccgtgccatgtgtaactaacaaactgaaaggcgagaaacagagattctctccctactga

SEQ ID NO: 12463 - DNA, 1317 bp, Artificial Sequence; identical to SEQ ID NO: 7058
  Synthetic polypeptide

SEQ ID NO: 12464 - DNA, 1083 bp, Artificial Sequence; identical to SEQ ID NO: 7162
  Synthetic polypeptide

SEQ ID NO: 12465 - DNA, 648 bp, Artificial Sequence; identical to SEQ ID NO: 7163
  Synthetic polypeptide

SEQ ID NO: 12466 - DNA, 244 bp, Artificial Sequence; identical to SEQ ID NO: 7164
  Synthetic polypeptide

SEQ ID NO: 12467 - DNA, 633 bp, Artificial Sequence; identical to SEQ ID NO: 7165
  Synthetic polypeptide

SEQ ID NO: 12468 - DNA, 495 bp, Artificial Sequence; identical to SEQ ID NO: 7166
  Synthetic polypeptide

SEQ ID NO: 12469 - DNA, 1334 bp, Artificial Sequence; identical to SEQ ID NO: 9457
  Synthetic polypeptide

SEQ ID NO: 12470 - DNA, 701 bp, Artificial Sequence; identical to SEQ ID NO: 9458
  Synthetic polypeptide

SEQ ID NO: 12471 - DNA, 2870 bp, Artificial Sequence; identical to SEQ ID NO: 9459
  Synthetic polypeptide

SEQ ID NO: 12472 - DNA, 1446 bp, Artificial Sequence; identical to SEQ ID NO: 8572
  Synthetic polypeptide

SEQ ID NO: 12473 - DNA, 104 bp, Artificial Sequence; identical to SEQ ID NO: 8573
  Synthetic polypeptide

SEQ ID NO: 12474 - DNA, 489 bp, Artificial Sequence; identical to SEQ ID NO: 8574
  Synthetic polypeptide

SEQ ID NO: 12475 - DNA, 859 bp, Artificial Sequence; identical to SEQ ID NO: 6990
  Synthetic polypeptide

SEQ ID NO: 12476 - DNA, 657 bp, Artificial Sequence; identical to SEQ ID NO: 6991
  Synthetic polypeptide

SEQ ID NO: 12477 - DNA, 587 bp, Artificial Sequence; identical to SEQ ID NO: 6992
  Synthetic polypeptide

SEQ ID NO: 12478 - DNA, 568 bp, Artificial Sequence; identical to SEQ ID NO: 6993
  Synthetic polypeptide

SEQ ID NO: 12479 - DNA, 494 bp, Artificial Sequence; identical to SEQ ID NO: 6994
  Synthetic polypeptide

SEQ ID NO: 12480 - DNA, 368 bp, Artificial Sequence; identical to SEQ ID NO: 6995
  Synthetic polypeptide

SEQ ID NO: 12481 - DNA, 2658 bp, Artificial Sequence; identical to SEQ ID NO: 9257
  Synthetic polypeptide

SEQ ID NO: 12482 - DNA, 507 bp, Artificial Sequence; identical to SEQ ID NO: 881
  Synthetic polypeptide

SEQ ID NO: 12483 - DNA, 1713 bp, Artificial Sequence
  Synthetic polypeptide
ctctctctaatcactttccccatgtcctgttttattttttctttatagtactgctagcagctgacattatctatgcctttgtttccattagaatgtgagccagatgaagaatcatggggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaa

SEQ ID NO: 12484 - DNA, 1732 bp, Artificial Sequence
  Synthetic polypeptide
ggggaaaagtattttcaaactcataataacggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatga

SEQ ID NO: 12485 - DNA, 607 bp, Artificial Sequence; identical to SEQ ID NO: 8464
  Synthetic polypeptide

SEQ ID NO: 12486 - DNA, 521 bp, Artificial Sequence; identical to SEQ ID NO: 8465
  Synthetic polypeptide

SEQ ID NO: 12487 - DNA, 2158 bp, Artificial Sequence; identical to SEQ ID NO: 514
  Synthetic polypeptide

SEQ ID NO: 12488 - DNA, 124 bp, Artificial Sequence; identical to SEQ ID NO: 515
  Synthetic polypeptide

SEQ ID NO: 12489 - DNA, 166 bp, Artificial Sequence; identical to SEQ ID NO: 516
  Synthetic polypeptide

SEQ ID NO: 12490 - DNA, 1776 bp, Artificial Sequence; identical to SEQ ID NO: 517
  Synthetic polypeptide

SEQ ID NO: 12491 - DNA, 319 bp, Artificial Sequence; identical to SEQ ID NO: 520
  Synthetic polypeptide

SEQ ID NO: 12492 - DNA, 1218 bp, Artificial Sequence; identical to SEQ ID NO: 8394
  Synthetic polypeptide

SEQ ID NO: 12493 - DNA, 1053 bp, Artificial Sequence; identical to SEQ ID NO: 8395
  Synthetic polypeptide

SEQ ID NO: 12494 - DNA, 942 bp, Artificial Sequence; identical to SEQ ID NO: 8396
  Synthetic polypeptide

SEQ ID NO: 12495 - DNA, 1091 bp, Artificial Sequence; identical to SEQ ID NO: 8397
  Synthetic polypeptide

SEQ ID NO: 12496 - DNA, 910 bp, Artificial Sequence
  Synthetic polypeptide
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtggtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12497 - DNA, 2154 bp, Artificial Sequence
  Synthetic polypeptide
agtagtcagcaaactatgtcccatggagccaaatttagcccatgacctgcaaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaa

SEQ ID NO: 12498 - DNA, 109 bp, Artificial Sequence
  Synthetic polypeptide
agtagtcagcaaactatgtcccatggagccaaatttagcccatgacctgcaaggtctcacgctgttgcatgtgtcaatcagtttatcatcagtaggactcaagctctaa

SEQ ID NO: 12499 - DNA, 1767 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaacttctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 12500 - DNA, 278 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaacttctgt

SEQ ID NO: 12501 - DNA, 531 bp, Artificial Sequence
  Synthetic polypeptide
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaacttctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacact

SEQ ID NO: 12502 - DNA, 588 bp, Artificial Sequence; identical to SEQ ID NO: 7495
  Synthetic polypeptide

SEQ ID NO: 12503 - DNA, 873 bp, Artificial Sequence; identical to SEQ ID NO: 6614
  Synthetic polypeptide

SEQ ID NO: 12504 - DNA, 207 bp, Artificial Sequence; identical to SEQ ID NO: 6615
  Synthetic polypeptide

SEQ ID NO: 12505 - DNA, 493 bp, Artificial Sequence; identical to SEQ ID NO: 9533
  Synthetic polypeptide

SEQ ID NO: 12506 - DNA, 304 bp, Artificial Sequence; identical to SEQ ID NO: 9534
  Synthetic polypeptide

SEQ ID NO: 12507 - DNA, 321 bp, Artificial Sequence; identical to SEQ ID NO: 10088
  Synthetic polypeptide

SEQ ID NO: 12508 - DNA, 993 bp, Artificial Sequence; identical to SEQ ID NO: 10089
  Synthetic polypeptide

SEQ ID NO: 12509 - DNA, 298 bp, Artificial Sequence; identical to SEQ ID NO: 10090
  Synthetic polypeptide

SEQ ID NO: 12510 - DNA, 891 bp, Artificial Sequence; identical to SEQ ID NO: 8626
  Synthetic polypeptide

SEQ ID NO: 12511 - DNA, 340 bp, Artificial Sequence
  Synthetic polypeptide
ggccgagtagtggagaaagagtgcctgggagtcaggagtcctgggcgctgccgctgacttcctggcgtccctgagtgagtccatttccctcccaggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctag

SEQ ID NO: 12512 - DNA, 116 bp, Artificial Sequence
  Synthetic polypeptide
ggccgagtagtggagaaagagtgcctgggagtcaggagtcctgggcgctgccgctgacttcctggcgtccctgagtgagtccatttccctcccaggtgtggcccaggcctacatga

SEQ ID NO: 12513 - DNA, 247 bp, Artificial Sequence
  Synthetic polypeptide
ggccgagtagtggagaaagagtgcctgggagtcaggagtcctgggcgctgccgctgacttcctggcgtccctgagtgagtccatttccctcccaggtgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtga

SEQ ID NO: 12514 - DNA, 307 bp, Artificial Sequence
  Synthetic polypeptide
ggccgagtagtggagaaagagtgcctgggagtcaggagtcctgggcgctgccgctgacttcctggcgtccctgagtgagtccatttccctcccaggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttag

SEQ ID NO: 12515 - DNA, 483 bp, Artificial Sequence; identical to SEQ ID NO: 7330
  Synthetic polypeptide

SEQ ID NO: 12516 - DNA, 36 bp, Artificial Sequence
  Synthetic polypeptide
ttaacatccttgtttattgagagaacattcaattga

SEQ ID NO: 12517 - DNA, 217 bp, Artificial Sequence
  Synthetic polypeptide
ttaacatccttgtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatga

SEQ ID NO: 12518 - DNA, 52 bp, Artificial Sequence
  Synthetic polypeptide
ttaacatccttgtttattgagagaacattcaattgatggcactggctgggct

SEQ ID NO: 12519 - DNA, 172 bp, Artificial Sequence
  Synthetic polypeptide
ttaacatccttgtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggac

SEQ ID NO: 12520 - DNA, 154 bp, Artificial Sequence
  Synthetic polypeptide
ttaacatccttgtttattgagagaacattcaattgatggcactggctgggctcccacaagaacattaaaggatgtcgtttggggattaaactctttgtttactgaggacttccggaataaagtggatgactacatcaaacgttatgccagatga

SEQ ID NO: 12521 - DNA, 20 bp, Artificial Sequence
  Synthetic polypeptide
ttaacatccttgtttattga

SEQ ID NO: 12522 - DNA, 174 bp, Artificial Sequence
  Synthetic polypeptide
ttaacatccttgtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggactt

SEQ ID NO: 12523 - DNA, 148 bp, Artificial Sequence
  Synthetic polypeptide
ttaacatccttgtttattgagagaacattcaattgatggcactggctgggctcccacaagaacattaaaggatgtcgtttggggattaaactctttgtttactgatcttttgaattttgatgatccactgaatattgaagctgcagaa

SEQ ID NO: 12524 - DNA, 325 bp, Artificial Sequence
  Synthetic polypeptide
ccaatggactaggcggtcctggagggcagagacctgtcttggtatcttcatattcccagcactctgcacaaggaatagagcctagaaggtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactga

SEQ ID NO: 12525 - DNA, 2636 bp, Artificial Sequence; identical to SEQ ID NO: 8432
  Synthetic polypeptide

SEQ ID NO: 12526 - DNA, 3776 bp, Artificial Sequence; identical to SEQ ID NO: 8433
  Synthetic polypeptide

SEQ ID NO: 12527 - DNA, 659 bp, Artificial Sequence; identical to SEQ ID NO: 7473
  Synthetic polypeptide

SEQ ID NO: 12528 - DNA, 1688 bp, Artificial Sequence; identical to SEQ ID NO: 7474
  Synthetic polypeptide

SEQ ID NO: 12529 - DNA, 365 bp, Artificial Sequence; identical to SEQ ID NO: 7364
  Synthetic polypeptide

SEQ ID NO: 12530 - DNA, 493 bp, Artificial Sequence
  Synthetic polypeptide
ggccggacgcagtggctcacgcctgtaatcccagcacttcaggaggctgaggcgggtggatcacaaggtgtccctggtggtgaatgtggccagcgagtgcggcttcacagaccagcactaccgagccctgcagcagctgcagcgagacctgggcccccaccactttaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataa

SEQ ID NO: 12531 - DNA, 619 bp, Artificial Sequence
  Synthetic polypeptide
gtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactca

SEQ ID NO: 12532 - DNA, 1052 bp, Artificial Sequence
  Synthetic polypeptide
cttgaattgtagctgccataattcccacctgttgtgggaggtatctggcggaggtaatgaatcatgggggcgagtctttcctgtgctgttcttgtgagagtaagtctcacgagagctggtcgttttataaacgggagttcctctgcaagtgttctcttgcctaccgccatgtgagacaagcctttgcttcttctttgccttccaccatgattgtgaggcctccccagctatgtggaactgacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatag

SEQ ID NO: 12533 - DNA, 445 bp, Artificial Sequence; identical to SEQ ID NO: 744
  Synthetic polypeptide

SEQ ID NO: 12534 - DNA, 59 bp, Artificial Sequence; identical to SEQ ID NO: 742
  Synthetic polypeptide

SEQ ID NO: 12535 - DNA, 123 bp, Artificial Sequence; identical to SEQ ID NO: 743
  Synthetic polypeptide

SEQ ID NO: 12536 - DNA, 1284 bp, Artificial Sequence; identical to SEQ ID NO: 648
  Synthetic polypeptide

SEQ ID NO: 12537 - DNA, 1077 bp, Artificial Sequence; identical to SEQ ID NO: 649
  Synthetic polypeptide

SEQ ID NO: 12538 - DNA, 972 bp, Artificial Sequence; identical to SEQ ID NO: 650
  Synthetic polypeptide

SEQ ID NO: 12539 - DNA, 3420 bp, Artificial Sequence
  Synthetic polypeptide
gaggatctgcaccgagtccctttcttctagtcattagctgggactttggcacgttgccgaaattctcagaagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatga

SEQ ID NO: 12540 - DNA, 3390 bp, Artificial Sequence
  Synthetic polypeptide
gaggatctgcaccgagtccctttcttctagtcattagctgggactttggcacgttgccgaaattctcagaagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatga

SEQ ID NO: 12541 - DNA, 464 bp, Artificial Sequence
  Synthetic polypeptide
gctgggcgcagtggctcacacctgtaatcccagcactttggaaggccaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtga

SEQ ID NO: 12542 - DNA, 1218 bp, Artificial Sequence; identical to SEQ ID NO: 654
  Synthetic polypeptide

SEQ ID NO: 12543 - DNA, 382 bp, Artificial Sequence
  Synthetic polypeptide
accatggctaaatcactcccttccctggacctcagtttttccagctgtaaaatggctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctga

SEQ ID NO: 12544 - DNA, 244 bp, Artificial Sequence
  Synthetic polypeptide
accatggctaaatcactcccttccctggacctcagtttttccagctgtaaaatggctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtgagcttctaa

SEQ ID NO: 12545 - DNA, 637 bp, Artificial Sequence
  Synthetic polypeptide
aggcagtatgacggcagtggaaagaaccctggactaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 12546 - DNA, 517 bp, Artificial Sequence
  Synthetic polypeptide
aggcagtatgacggcagtggaaagaaccctggactaacgatttcgagatttactactgcctccatctagtcaagactccgaaattctgcccttcattcaatctagaaattatcccaaggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 12547 - DNA, 574 bp, Artificial Sequence
  Synthetic polypeptide
aggcagtatgacggcagtggaaagaaccctggactaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttggttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 12548 - DNA, 981 bp, Artificial Sequence
  Synthetic polypeptide
tgcagtcgggaaggggaggacgggaagtctagccggcttggacccgccccactctgttacctgccagatgacgctgaggaaactgcttttcttctcgaggcctccgttgcctcgtctgtgcccgggcggtgacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggccccgctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctga

SEQ ID NO: 12549 - DNA, 1110 bp, Artificial Sequence; identical to SEQ ID NO: 8310
  Synthetic polypeptide

SEQ ID NO: 12550 - DNA, 564 bp, Artificial Sequence
  Synthetic polypeptide
aagcaagacagcaagagacagcaagagatggcattttgtgagaagatggacatagcgatcagcaatgggcaagacagctattggagaagtggcaagacagtgatcagtgagagagggtgtgatggggatcagcactacagcgagcaaagctacagagttgctaacattgcagagctgttaacactagccaaaggctgttttaagagccatcatctttcctgacaggcggtggagctgagcagaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 12551 - DNA, 1681 bp, Artificial Sequence; identical to SEQ ID NO: 714
  Synthetic polypeptide

SEQ ID NO: 12552 - DNA, 1543 bp, Artificial Sequence; identical to SEQ ID NO: 717
  Synthetic polypeptide

SEQ ID NO: 12553 - DNA, 258 bp, Artificial Sequence; identical to SEQ ID NO: 719
  Synthetic polypeptide

SEQ ID NO: 12554 - DNA, 1058 bp, Artificial Sequence; identical to SEQ ID NO: 7375
  Synthetic polypeptide

SEQ ID NO: 12555 - DNA, 1008 bp, Artificial Sequence
  Synthetic polypeptide
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaa

SEQ ID NO: 12556 - DNA, 1077 bp, Artificial Sequence
  Synthetic polypeptide
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaagaaattggtaccaccgtgcacttcaagcaaaaaggacctgggtcggtgagaggaataaatggatccatcagtctggccgtaccactgtggctgctggcagcatctctgctctgccttctcagcaaatgttaa

SEQ ID NO: 12557 - DNA, 505 bp, Artificial Sequence
  Synthetic polypeptide
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactg

SEQ ID NO: 12558 - DNA, 304 bp, Artificial Sequence; identical to SEQ ID NO: 7490
  Synthetic polypeptide

SEQ ID NO: 12559 - DNA, 1200 bp, Artificial Sequence
  Synthetic polypeptide
cagcttagaagtcagatttgagccaaaattgttgtactgctgctgctgctgcttttctctgtggctttggacacctcagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactga

SEQ ID NO: 12560 - DNA, 118 bp, Artificial Sequence
  Synthetic polypeptide
cagcttagaagtcagatttgagccaaaattgttgtactgctgctgctgctgcttttctctgtggctttggacacctcagacacagagattgactggaaggcctacatggccgaggtag

SEQ ID NO: 12561 - DNA, 1635 bp, Artificial Sequence; identical to SEQ ID NO: 11249
  Synthetic polypeptide

SEQ ID NO: 12562 - DNA, 1704 bp, Artificial Sequence; identical to SEQ ID NO: 11250
  Synthetic polypeptide

SEQ ID NO: 12563 - DNA, 333 bp, Artificial Sequence; identical to SEQ ID NO: 6583
  Synthetic polypeptide

SEQ ID NO: 12564 - DNA, 288 bp, Artificial Sequence
  Synthetic polypeptide
tgtttgttcacgttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtga

SEQ ID NO: 12565 - DNA, 1791 bp, Artificial Sequence
  Synthetic polypeptide
agcaggtcctccaataacattgctttgttcaacatcttttcattataacattgctgagggaaaaaaatcgatttccagctgggccactgtctgtataaggagtttgcagattctccccatgtccttgtgggctttctccgggcgctctggtttcttctcacgtctcaaatctgtgcatgttaggttaggtgaacaggcatgcctacgtggtcccagcctgcgtgagtataggtgtgcttgtgtgagtttgccctgcaatgggatggcatcctggtcaagactagttacctcctggtgccctgagctgcttgataggcttggcaacccacaaccctgaaatggaatcagcagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataa

SEQ ID NO: 12566 - DNA, 978 bp, Artificial Sequence
  Synthetic polypeptide
agcaggtcctccaataacattgctttgttcaacatcttttcattataacattgctgagggaaaaaaatcgatttccagctgggccactgtctgtataaggagtttgcagattctccccatgtccttgtgggctttctccgggcgctctggtttcttctcacgtctcaaatctgtgcatgttaggttaggtgaacaggcatgcctacgtggtcccagcctgcgtgagtataggtgtgcttgtgtgagtttgccctgcaatgggatggcatcctggtcaagactagttacctcctggtgccctgagctgcttgataggcttggcaacccacaaccctgaaatggaatcagcagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatggggccagtgttgtatag

SEQ ID NO: 12567 - DNA, 1001 bp, Artificial Sequence
  Synthetic polypeptide
agcaggtcctccaataacattgctttgttcaacatcttttcattataacattgctgagggaaaaaaatcgatttccagctgggccactgtctgtataaggagtttgcagattctccccatgtccttgtgggctttctccgggcgctctggtttcttctcacgtctcaaatctgtgcatgttaggttaggtgaacaggcatgcctacgtggtcccagcctgcgtgagtataggtgtgcttgtgtgagtttgccctgcaatgggatggcatcctggtcaagactagttacctcctggtgccctgagctgcttgataggcttggcaacccacaaccctgaaatggaatcagcagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatat

SEQ ID NO: 12568 - DNA, 894 bp, Artificial Sequence
  Synthetic polypeptide
agcaggtcctccaataacattgctttgttcaacatcttttcattataacattgctgagggaaaaaaatcgatttccagctgggccactgtctgtataaggagtttgcagattctccccatgtccttgtgggctttctccgggcgctctggtttcttctcacgtctcaaatctgtgcatgttaggttaggtgaacaggcatgcctacgtggtcccagcctgcgtgagtataggtgtgcttgtgtgagtttgccctgcaatgggatggcatcctggtcaagactagttacctcctggtgccctgagctgcttgataggcttggcaacccacaaccctgaaatggaatcagcagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctc

SEQ ID NO: 12569 - DNA, 599 bp, Artificial Sequence; identical to SEQ ID NO: 9649
  Synthetic polypeptide

SEQ ID NO: 12570 - DNA, 686 bp, Artificial Sequence; identical to SEQ ID NO: 9650
  Synthetic polypeptide

SEQ ID NO: 12571 - DNA, 956 bp, Artificial Sequence; identical to SEQ ID NO: 7135
  Synthetic polypeptide

SEQ ID NO: 12572 - DNA, 133 bp, Artificial Sequence; identical to SEQ ID NO: 6551
  Synthetic polypeptide

SEQ ID NO: 12573 - DNA, 1226 bp, Artificial Sequence
  Synthetic polypeptide
gcggggtgcagtggctcacacctataatcccagcactttgggaggccgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattga

SEQ ID NO: 12574 - DNA, 170 bp, Artificial Sequence
  Synthetic polypeptide
gcggggtgcagtggctcacacctataatcccagcactttgggaggccgaggttcttggtgagattcaggaaattgtgaaaacagggctttgggtagatttggataatttggaattagaagatattgacacaacagatatcaatctggatgaagatattttggatgattga

SEQ ID NO: 12575 - DNA, 751 bp, Artificial Sequence
  Synthetic polypeptide
tgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataa

SEQ ID NO: 12576 - DNA, 343 bp, Artificial Sequence
  Synthetic polypeptide
tgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgttgataaaaattaaagagtgggtggacaagtatgacccaggtgctttggtcatt

SEQ ID NO: 12577 - DNA, 336 bp, Artificial Sequence; identical to SEQ ID NO: 7520
  Synthetic polypeptide

SEQ ID NO: 12578 - DNA, 346 bp, Artificial Sequence; identical to SEQ ID NO: 7521
  Synthetic polypeptide

SEQ ID NO: 12579 - DNA, 1691 bp, Artificial Sequence
  Synthetic polypeptide
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12580 - DNA, 522 bp, Artificial Sequence
  Synthetic polypeptide
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgg

SEQ ID NO: 12581 - DNA, 796 bp, Artificial Sequence
  Synthetic polypeptide
tgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgtgagccagttagacctcttttctttataaattacccagtctcaggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataa

SEQ ID NO: 12582 - DNA, 388 bp, Artificial Sequence
  Synthetic polypeptide
tgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgtgagccagttagacctcttttctttataaattacccagtctcaggttgataaaaattaaagagtgggtggacaagtatgacccaggtgctttggtcatt

SEQ ID NO: 12583 - DNA, 1533 bp, Artificial Sequence; identical to SEQ ID NO: 8543
  Synthetic polypeptide

SEQ ID NO: 12584 - DNA, 5853 bp, Artificial Sequence; identical to SEQ ID NO: 7611
  Synthetic polypeptide

SEQ ID NO: 12585 - DNA, 5826 bp, Artificial Sequence; identical to SEQ ID NO: 7612
  Synthetic polypeptide

SEQ ID NO: 12586 - DNA, 917 bp, Artificial Sequence; identical to SEQ ID NO: 7613
  Synthetic polypeptide

SEQ ID NO: 12587 - DNA, 382 bp, Artificial Sequence; identical to SEQ ID NO: 434
  Synthetic polypeptide

SEQ ID NO: 12588 - DNA, 571 bp, Artificial Sequence
  Synthetic polypeptide
ggcctggcacagtggctcatgcctgtaatcccagcacttcaggaggccgaggcaagcagatcatttggggtcaggagttcgagaccagcctggacaacatgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtag

SEQ ID NO: 12589 - DNA, 307 bp, Artificial Sequence
  Synthetic polypeptide
ggcctggcacagtggctcatgcctgtaatcccagcacttcaggaggccgaggcaagcagatcatttggggtcaggagttcgagaccagcctggacaacatgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccgatctcctggctgcaaatcagcccatcggcagtgtttcttga

SEQ ID NO: 12590 - DNA, 619 bp, Artificial Sequence
  Synthetic polypeptide
ggcctggcacagtggctcatgcctgtaatcccagcacttcaggaggccgaggcaagcagatcatttggggtcaggagttcgagaccagcctggacaacatggtgaaaccctgtctctactaaaaacagaaaaattagccgggcgtggtgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtag

SEQ ID NO: 12591 - DNA, 355 bp, Artificial Sequence
  Synthetic polypeptide
ggcctggcacagtggctcatgcctgtaatcccagcacttcaggaggccgaggcaagcagatcatttggggtcaggagttcgagaccagcctggacaacatggtgaaaccctgtctctactaaaaacagaaaaattagccgggcgtggtgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccgatctcctggctgcaaatcagcccatcggcagtgtttcttga

SEQ ID NO: 12592 - DNA, 1075 bp, Artificial Sequence
  Synthetic polypeptide
ccactccctacttcacaccccatgtttcagccatattaagcagcttgtagttctacagctggactacgctgtatttttttttttttctctaggcctttggatatgctgttttccctgccttggattggcttcctactgataaatcatgtttattctctcagaataagctaagatgtcacctggactggaagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcacgagaatgacatgcgtgggaagtgcacggtgggcgatcgctggtccagtcagcagggcagcaaagcagtctacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcaccactgcattggtggaggaggatactttccagaggccagtccccagcagtgtggagatttttctggttttgattggagtggatatggaactcatgttggttacagcagcagccgtgagataactgaggcagctgtgcttctattctatcgttga

SEQ ID NO: 12593 - DNA, 213 bp, Artificial Sequence; identical to SEQ ID NO: 7877
  Synthetic polypeptide

SEQ ID NO: 12594 - DNA, 852 bp, Artificial Sequence
  Synthetic polypeptide
agcaaactgtcgcaaggacagaaaaccaaacatcgcatgttctcactcataggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 12595 - DNA, 1161 bp, Artificial Sequence
  Synthetic polypeptide
agcaaactgtcgcaaggacagaaaaccaaacatcgcatgttctcactcataggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 12596 - DNA, 255 bp, Artificial Sequence
  Synthetic polypeptide
ggccaggcacagtggctcatgccgataatccctgtaatcactttgggaggccaagatcgggggattgcttgaccctaggagttcaagaccagcctgggcaacatgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaa

SEQ ID NO: 12597 - DNA, 1250 bp, Artificial Sequence; identical to SEQ ID NO: 6341
  Synthetic polypeptide

SEQ ID NO: 12598 - DNA, 1379 bp, Artificial Sequence; identical to SEQ ID NO: 6342
  Synthetic polypeptide

SEQ ID NO: 12599 - DNA, 514 bp, Artificial Sequence; identical to SEQ ID NO: 6343
  Synthetic polypeptide

SEQ ID NO: 12600 - DNA, 2582 bp, Artificial Sequence
  Synthetic polypeptide
gtccagagaacaaacctctggtcctttagatctgttgccacctactgtgggaactttgtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctga

SEQ ID NO: 12601 - DNA, 353 bp, Artificial Sequence
  Synthetic polypeptide
gtccagagaacaaacctctggtcctttagatctgttgccacctactgtgggaactttgtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaag

SEQ ID NO: 12602 - DNA, 142 bp, Artificial Sequence
  Synthetic polypeptide
gtccagagaacaaacctctggtcctttagatctgttgccacctactgtgggaactttgtgatgaaaatgccaggaaagatttaaagacattaccagcctttccaaccaaaactcttcaggagcatccatcccttgcctactg

SEQ ID NO: 12603 - DNA, 66 bp, Artificial Sequence
  Synthetic polypeptide
gtccagagaacaaacctctggtcctttagatctgttgccacctactgtgggaactttgtgatgaaa

SEQ ID NO: 12604 - DNA, 161 bp, Artificial Sequence; identical to SEQ ID NO: 7668
  Synthetic polypeptide

SEQ ID NO: 12605 - DNA, 178 bp, Artificial Sequence; identical to SEQ ID NO: 7669
  Synthetic polypeptide

SEQ ID NO: 12606 - DNA, 560 bp, Artificial Sequence; identical to SEQ ID NO: 6322
  Synthetic polypeptide

SEQ ID NO: 12607 - DNA, 678 bp, Artificial Sequence; identical to SEQ ID NO: 8918
  Synthetic polypeptide

SEQ ID NO: 12608 - DNA, 726 bp, Artificial Sequence; identical to SEQ ID NO: 8919
  Synthetic polypeptide

SEQ ID NO: 12609 - DNA, 355 bp, Artificial Sequence; identical to SEQ ID NO: 8039
  Synthetic polypeptide

SEQ ID NO: 12610 - DNA, 282 bp, Artificial Sequence; identical to SEQ ID NO: 7621
  Synthetic polypeptide

SEQ ID NO: 12611 - DNA, 647 bp, Artificial Sequence
  Synthetic polypeptide
agaaggcaggctctgttgtcaggctgcctgggttcagatcccagctctgcacctggctgatgtgtctccttgggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctag

SEQ ID NO: 12612 - DNA, 473 bp, Artificial Sequence
  Synthetic polypeptide
agaaggcaggctctgttgtcaggctgcctgggttcagatcccagctctgcacctggctgatgtgtctccttgggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttgggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtga

SEQ ID NO: 12613 - DNA, 402 bp, Artificial Sequence
  Synthetic polypeptide
agaaggcaggctctgttgtcaggctgcctgggttcagatcccagctctgcacctggctgatgtgtctccttgggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttgggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcagg

SEQ ID NO: 12614 - DNA, 591 bp, Artificial Sequence
  Synthetic polypeptide
agaaggcaggctctgttgtcaggctgcctgggttcagatcccagctctgcacctggctgatgtgtctccttgggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggcc

SEQ ID NO: 12615 - DNA, 68 bp, Artificial Sequence; identical to SEQ ID NO: 6862
  Synthetic polypeptide

SEQ ID NO: 12616 - DNA, 1053 bp, Artificial Sequence; identical to SEQ ID NO: 6863
  Synthetic polypeptide

SEQ ID NO: 12617 - DNA, 407 bp, Artificial Sequence; identical to SEQ ID NO: 6864
  Synthetic polypeptide

SEQ ID NO: 12618 - DNA, 673 bp, Artificial Sequence; identical to SEQ ID NO: 6865
  Synthetic polypeptide

SEQ ID NO: 12619 - DNA, 1004 bp, Artificial Sequence; identical to SEQ ID NO: 8920
  Synthetic polypeptide

SEQ ID NO: 12620 - DNA, 887 bp, Artificial Sequence; identical to SEQ ID NO: 8921
  Synthetic polypeptide

SEQ ID NO: 12621 - DNA, 1266 bp, Artificial Sequence; identical to SEQ ID NO: 9947
  Synthetic polypeptide

SEQ ID NO: 12622 - DNA, 1537 bp, Artificial Sequence; identical to SEQ ID NO: 9702
  Synthetic polypeptide

SEQ ID NO: 12623 - DNA, 418 bp, Artificial Sequence; identical to SEQ ID NO: 11223
  Synthetic polypeptide

SEQ ID NO: 12624 - DNA, 386 bp, Artificial Sequence; identical to SEQ ID NO: 11224
  Synthetic polypeptide

SEQ ID NO: 12625 - DNA, 457 bp, Artificial Sequence; identical to SEQ ID NO: 11225
  Synthetic polypeptide

SEQ ID NO: 12626 - DNA, 496 bp, Artificial Sequence; identical to SEQ ID NO: 11226
  Synthetic polypeptide

SEQ ID NO: 12627 - DNA, 385 bp, Artificial Sequence; identical to SEQ ID NO: 11229
  Synthetic polypeptide

SEQ ID NO: 12628 - DNA, 385 bp, Artificial Sequence; identical to SEQ ID NO: 11229
  Synthetic polypeptide

SEQ ID NO: 12629 - DNA, 385 bp, Artificial Sequence; identical to SEQ ID NO: 11229
  Synthetic polypeptide

SEQ ID NO: 12630 - DNA, 418 bp, Artificial Sequence; identical to SEQ ID NO: 11223
  Synthetic polypeptide

SEQ ID NO: 12631 - DNA, 418 bp, Artificial Sequence; identical to SEQ ID NO: 11223
  Synthetic polypeptide

SEQ ID NO: 12632 - DNA, 418 bp, Artificial Sequence; identical to SEQ ID NO: 11223
  Synthetic polypeptide

SEQ ID NO: 12633 - DNA, 418 bp, Artificial Sequence; identical to SEQ ID NO: 11223
  Synthetic polypeptide

SEQ ID NO: 12634 - DNA, 418 bp, Artificial Sequence; identical to SEQ ID NO: 11223
  Synthetic polypeptide

SEQ ID NO: 12635 - DNA, 1320 bp, Artificial Sequence; identical to SEQ ID NO: 8817
  Synthetic polypeptide

SEQ ID NO: 12636 - DNA, 420 bp, Artificial Sequence; identical to SEQ ID NO: 8818
  Synthetic polypeptide

SEQ ID NO: 12637 - DNA, 632 bp, Artificial Sequence; identical to SEQ ID NO: 9782
  Synthetic polypeptide

SEQ ID NO: 12638 - DNA, 163 bp, Artificial Sequence; identical to SEQ ID NO: 480
  Synthetic polypeptide

SEQ ID NO: 12639 - DNA, 104 bp, Artificial Sequence; identical to SEQ ID NO: 481
  Synthetic polypeptide

SEQ ID NO: 12640 - DNA, 110 bp, Artificial Sequence
  Synthetic polypeptide
ccaactcctcctctttctcctcctcctcagtctacacgaaaatgaaaatgacaacaatgaagacctttatgatgatctacttccacttaatgaatagtaagaggaagtga

SEQ ID NO: 12641 - DNA, 352 bp, Artificial Sequence; identical to SEQ ID NO: 8547
  Synthetic polypeptide

SEQ ID NO: 12642 - DNA, 274 bp, Artificial Sequence; identical to SEQ ID NO: 8548
  Synthetic polypeptide

SEQ ID NO: 12643 - DNA, 246 bp, Artificial Sequence; identical to SEQ ID NO: 8549
  Synthetic polypeptide

SEQ ID NO: 12644 - DNA, 80 bp, Artificial Sequence; identical to SEQ ID NO: 6364
  Synthetic polypeptide

SEQ ID NO: 12645 - DNA, 217 bp, Artificial Sequence; identical to SEQ ID NO: 6365
  Synthetic polypeptide

SEQ ID NO: 12646 - DNA, 1791 bp, Artificial Sequence
  Synthetic polypeptide
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttag

SEQ ID NO: 12647 - DNA, 826 bp, Artificial Sequence
  Synthetic polypeptide
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaag

SEQ ID NO: 12648 - DNA, 666 bp, Artificial Sequence
  Synthetic polypeptide
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtg

SEQ ID NO: 12649 - DNA, 627 bp, Artificial Sequence
  Synthetic polypeptide
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagc

SEQ ID NO: 12650 - DNA, 570 bp, Artificial Sequence
  Synthetic polypeptide
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaa

SEQ ID NO: 12651 - DNA, 494 bp, Artificial Sequence
  Synthetic polypeptide
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgt

SEQ ID NO: 12652 - DNA, 464 bp, Artificial Sequence
  Synthetic polypeptide
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtccc

SEQ ID NO: 12653 - DNA, 596 bp, Artificial Sequence
  Synthetic polypeptide
tgatatggtttggatttttgtctctgcccgaatctcatgttgaattataattcccagtgttggaggaggggcctggtatgagacgattggaccgcaggggtggatttccttcttgctgttctcgtgataatgagttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataa

SEQ ID NO: 12654 - DNA, 188 bp, Artificial Sequence
  Synthetic polypeptide
tgatatggtttggatttttgtctctgcccgaatctcatgttgaattataattcccagtgttggaggaggggcctggtatgagacgattggaccgcaggggtggatttccttcttgctgttctcgtgataatgagttgataaaaattaaagagtgggtggacaagtatgacccaggtgctttggtcatt

SEQ ID NO: 12655 - DNA, 459 bp, Artificial Sequence; identical to SEQ ID NO: 6510
  Synthetic polypeptide

SEQ ID NO: 12656 - DNA, 504 bp, Artificial Sequence; identical to SEQ ID NO: 6511
  Synthetic polypeptide

SEQ ID NO: 12657 - DNA, 3887 bp, Artificial Sequence
  Synthetic polypeptide
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12658 - DNA, 3914 bp, Artificial Sequence
  Synthetic polypeptide
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12659 - DNA, 4010 bp, Artificial Sequence
  Synthetic polypeptide
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12660 - DNA, 3773 bp, Artificial Sequence
  Synthetic polypeptide
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12661 - DNA, 581 bp, Artificial Sequence
  Synthetic polypeptide
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctga

SEQ ID NO: 12662 - DNA, 354 bp, Artificial Sequence
  Synthetic polypeptide
atcagccgggcgtggtggttcacgcctgtaatcccagcactttgggaggctgaggcaggagaatggcttgaacctgggacgtagaggttgcaatgagccaagattgcgccattgcactccagcctgggcaacagagtcagactccgtctcagaaaaaagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaa

SEQ ID NO: 12663 - DNA, 366 bp, Artificial Sequence
  Synthetic polypeptide
atcagccgggcgtggtggttcacgcctgtaatcccagcactttgggaggctgaggcaggagaatggcttgaacctgggacgtagaggttgcaatgagccaagattgcgccattgcactccagcctgggcaacagagtcagactccgtctcagaaaaaagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacaggtaagaacctgcatgaaaatgtcgtag

SEQ ID NO: 12664 - DNA, 197 bp, Artificial Sequence
  Synthetic polypeptide
atcagccgggcgtggtggttcacgcctgtaatcccagcactttgggaggctgaggcaggagaatggcttgaacctgggacgtagaggttgcaatgagccaagattgcgccattgcactccagcctgggcaacagagtcagactccgtctcagaaaaaagtaccttctggatacctccacatggtccgagtgcactga

SEQ ID NO: 12665 - DNA, 921 bp, Artificial Sequence; identical to SEQ ID NO: 8805
  Synthetic polypeptide

SEQ ID NO: 12666 - DNA, 389 bp, Artificial Sequence
  Synthetic polypeptide
ctcagtgggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtga

SEQ ID NO: 12667 - DNA, 470 bp, Artificial Sequence
  Synthetic polypeptide
ctcagtgggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtga

SEQ ID NO: 12668 - DNA, 373 bp, Artificial Sequence
  Synthetic polypeptide
ctcagtgggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaagctgtgtttcagccacactgaacccaattacacacagcgggagaacgcagtaaacagctttcccacaagagccgtctcctgtcctcctgttccccagggcagggagccccaggacaacaccagact

SEQ ID NO: 12669 - DNA, 332 bp, Artificial Sequence
  Synthetic polypeptide
ctcagtgggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatga

SEQ ID NO: 12670 - DNA, 119 bp, Artificial Sequence
  Synthetic polypeptide
ctcagtgggacatctcgcccgtcctgaaggaccccgcctccttccgcgccgccatcggcctcctggcgcgacacctgaaggcgacccacgggggccgcatcgactacatcgcaggctga

SEQ ID NO: 12671 - DNA, 416 bp, Artificial Sequence
  Synthetic polypeptide
ctcagtgggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggggctggcctggagcacctgctctctgcagcccaggccaactggggacctcaccctcccatccccaggaaccatgaacgctgcctgtga

SEQ ID NO: 12672 - DNA, 753 bp, Artificial Sequence; identical to SEQ ID NO: 7919
  Synthetic polypeptide

SEQ ID NO: 12673 - DNA, 873 bp, Artificial Sequence; identical to SEQ ID NO: 7920
  Synthetic polypeptide

SEQ ID NO: 12674 - DNA, 964 bp, Artificial Sequence
  Synthetic polypeptide
ttctcttgattttgccgcttaagtagctgttgaatctgcgaattccctatgtcctggctataactcctctagtttagaatattgtcatttgatgcctggattattgcagcagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaa

SEQ ID NO: 12675 - DNA, 151 bp, Artificial Sequence
  Synthetic polypeptide
ttctcttgattttgccgcttaagtagctgttgaatctgcgaattccctatgtcctggctataactcctctagtttagaatattgtcatttgatgcctggattattgcagcagaaggccttacgaccggatatgggctataatacattagcc

SEQ ID NO: 12676 - DNA, 415 bp, Artificial Sequence
  Synthetic polypeptide
ttctcttgattttgccgcttaagtagctgttgaatctgcgaattccctatgtcctggctataactcctctagtttagaatattgtcatttgatgcctggattattgcagcagaaggccttacgaccggatatgggctataatacattagccaactttcgaatagaaaagaaaattggtcgcggacaatttagtgaagtttatagagcagcctgtctcttggatggagtaccagtagctttaaaaaaagtgcaggtttgcctgttacctgtatgggaaagaagagtgtgtgcgctaaatgcatgttacttcttggaaatcataaagggatctgagagcctacagtatatggcaacattaaccaatctttttgaaaatttacctgtatcccatcatggttcatttgcaaaaaaataa

SEQ ID NO: 12677 - DNA, 241 bp, Artificial Sequence
  Synthetic polypeptide
ttctcttgattttgccgcttaagtagctgttgaatctgcgaattccctatgtcctggctataactcctctagtttagaatattgtcatttgatgcctggattattgcagcagaaggccttacgaccggatatgggctataatacattagccaactttcgaatagaaaagaaaattggtcgcggacaatttagtgaagtttatagagcagcctgtctcttggatggagtaccagtagcttta

SEQ ID NO: 12678 - DNA, 302 bp, Artificial Sequence
  Synthetic polypeptide
ttctcttgattttgccgcttaagtagctgttgaatctgcgaattccctatgtcctggctataactcctctagtttagaatattgtcatttgatgcctggattattgcagcagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaa

SEQ ID NO: 12679 - DNA, 554 bp, Artificial Sequence
  Synthetic polypeptide
aaatataaaaggtaaattatagagttagtagaaaatcatatagggcaatatctttgttaggagcagggaaaaacttcttgatgaaacttcaaatataaatcgtaagaaacttcaaatataaatcgtaaggccaaaaacattcatgaattaaattacattaaaaataaaacttctttcagcaaaggactacatggaaaaagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaa

SEQ ID NO: 12680 - DNA, 473 bp, Artificial Sequence
  Synthetic polypeptide
aaatataaaaggtaaattatagagttagtagaaaatcatatagggcaatatctttgttaggagcagggaaaaacttcttgatgaaacttcaaatataaatcgtaagaaacttcaaatataaatcgtaaggccaaaaacattcatgaattaaattacattaaaaataaaacttctttcagcaaaggactacatggaaaaagatagatgatacttgttcgtcttttctgtccattgattctcagcctcaggcatccaacgcactggaggagctttgctttatgattatgggaatgctaccaaagcctcagtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaa

SEQ ID NO: 12681 - DNA, 479 bp, Artificial Sequence
  Synthetic polypeptide
aaatataaaaggtaaattatagagttagtagaaaatcatatagggcaatatctttgttaggagcagggaaaaacttcttgatgaaacttcaaatataaatcgtaagaaacttcaaatataaatcgtaaggccaaaaacattcatgaattaaattacattaaaaataaaacttctttcagcaaaggactacatggaaaaagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtggaagaattccaaagtccctttgcaagtcaaagtcgaggatattttttattcaggccacggaatggaagaaggtcagcagggttcatttaa

SEQ ID NO: 12682 - DNA, 3055 bp, Artificial Sequence; identical to SEQ ID NO: 709
  Synthetic polypeptide

SEQ ID NO: 12683 - DNA, 3058 bp, Artificial Sequence; identical to SEQ ID NO: 710
  Synthetic polypeptide

SEQ ID NO: 12684 - DNA, 287 bp, Artificial Sequence
  Synthetic polypeptide
ggccaggcgtgggattcacacctttaatcccagcaccttgggaggctgaggtgggatgatcacttgagtccaggagtttgacaccagctgggcagcataatccagctagcgggagcagcatcgactgggcatatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactag

SEQ ID NO: 12685 - DNA, 892 bp, Artificial Sequence
  Synthetic polypeptide
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 12686 - DNA, 1075 bp, Artificial Sequence
  Synthetic polypeptide
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 12687 - DNA, 197 bp, Artificial Sequence
  Synthetic polypeptide
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaa

SEQ ID NO: 12688 - DNA, 769 bp, Artificial Sequence
  Synthetic polypeptide
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 12689 - DNA, 952 bp, Artificial Sequence
  Synthetic polypeptide
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 12690 - DNA, 1515 bp, Artificial Sequence
  Synthetic polypeptide
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12691 - DNA, 1239 bp, Artificial Sequence
  Synthetic polypeptide
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaaggtgacttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12692 - DNA, 346 bp, Artificial Sequence
  Synthetic polypeptide
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgtatccctcatgggcttcctgttccttttgggcttatacatctcgtccctggcttcctgcatgg

SEQ ID NO: 12693 - DNA, 1443 bp, Artificial Sequence
  Synthetic polypeptide
gggttttagttcacactgtgccacccacacaagcaggctgggtaaccttgggtctatttctgaccttttagaatattgtttctctctgtaccacaggaagaagcttctctgcccttcattgggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12694 - DNA, 1167 bp, Artificial Sequence
  Synthetic polypeptide
gggttttagttcacactgtgccacccacacaagcaggctgggtaaccttgggtctatttctgaccttttagaatattgtttctctctgtaccacaggaagaagcttctctgcccttcattgggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaaggtgacttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12695 - DNA, 274 bp, Artificial Sequence
  Synthetic polypeptide
gggttttagttcacactgtgccacccacacaagcaggctgggtaaccttgggtctatttctgaccttttagaatattgtttctctctgtaccacaggaagaagcttctctgcccttcattgggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgg

SEQ ID NO: 12696 - DNA, 2289 bp, Artificial Sequence
  Synthetic polypeptide
tggaatgggttcccttgagaggcagtgaggtccctgttcctggaagcattcaagtagagctggtgatggctgggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagaagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcagggatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcaccggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactag

SEQ ID NO: 12697 - DNA, 2910 bp, Artificial Sequence
  Synthetic polypeptide
tggaatgggttcccttgagaggcagtgaggtccctgttcctggaagcattcaagtagagctggtgatggctgggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgagaaggagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactag

SEQ ID NO: 12698 - DNA, 2235 bp, Artificial Sequence
  Synthetic polypeptide
tggaatgggttcccttgagaggcagtgaggtccctgttcctggaagcattcaagtagagctggtgatggctgggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgagaaggagtgcctcccccgggacgtcagagctggctgccggcacagcggcggttgcctcaacgggggcctgtgtgacccgcacacgggccgctgcctctgcccagccggctggactggggacaagtgtcagagcccctgtgccaagggcacattcgggcctcactgtgaggggcgctgtgcctgccggtggggaggcccctgccaccttgccaccggggcctgcctctgccctccggggtggcggggggctccaggtgtgagaatgcctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtga

SEQ ID NO: 12699 - DNA, 414 bp, Artificial Sequence; identical to SEQ ID NO: 6481
  Synthetic polypeptide

SEQ ID NO: 12700 - DNA, 337 bp, Artificial Sequence; identical to SEQ ID NO: 6393
  Synthetic polypeptide

SEQ ID NO: 12701 - DNA, 605 bp, Artificial Sequence; identical to SEQ ID NO: 8066
  Synthetic polypeptide

SEQ ID NO: 12702 - DNA, 372 bp, Artificial Sequence; identical to SEQ ID NO: 8067
  Synthetic polypeptide

SEQ ID NO: 12703 - DNA, 422 bp, Artificial Sequence; identical to SEQ ID NO: 8068
  Synthetic polypeptide

SEQ ID NO: 12704 - DNA, 476 bp, Artificial Sequence; identical to SEQ ID NO: 8069
  Synthetic polypeptide

SEQ ID NO: 12705 - DNA, 1188 bp, Artificial Sequence; identical to SEQ ID NO: 8232
  Synthetic polypeptide

SEQ ID NO: 12706 - DNA, 853 bp, Artificial Sequence; identical to SEQ ID NO: 8074
  Synthetic polypeptide

SEQ ID NO: 12707 - DNA, 1966 bp, Artificial Sequence
  Synthetic polypeptide
ctggcatacagcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtga

SEQ ID NO: 12708 - DNA, 560 bp, Artificial Sequence; identical to SEQ ID NO: 6322
  Synthetic polypeptide

SEQ ID NO: 12709 - DNA, 404 bp, Artificial Sequence; identical to SEQ ID NO: 6813
  Synthetic polypeptide

SEQ ID NO: 12710 - DNA, 417 bp, Artificial Sequence; identical to SEQ ID NO: 6814
  Synthetic polypeptide

SEQ ID NO: 12711 - DNA, 485 bp, Artificial Sequence; identical to SEQ ID NO: 6815
  Synthetic polypeptide

SEQ ID NO: 12712 - DNA, 1745 bp, Artificial Sequence; identical to SEQ ID NO: 6816
  Synthetic polypeptide

SEQ ID NO: 12713 - DNA, 2484 bp, Artificial Sequence; identical to SEQ ID NO: 9884
  Synthetic polypeptide

SEQ ID NO: 12714 - DNA, 1554 bp, Artificial Sequence; identical to SEQ ID NO: 8073
  Synthetic polypeptide

SEQ ID NO: 12715 - DNA, 423 bp, Artificial Sequence; identical to SEQ ID NO: 6550
  Synthetic polypeptide

SEQ ID NO: 12716 - DNA, 163 bp, Artificial Sequence; identical to SEQ ID NO: 480
  Synthetic polypeptide

SEQ ID NO: 12717 - DNA, 104 bp, Artificial Sequence; identical to SEQ ID NO: 481
  Synthetic polypeptide

SEQ ID NO: 12718 - DNA, 523 bp, Artificial Sequence; identical to SEQ ID NO: 8925
  Synthetic polypeptide

SEQ ID NO: 12719 - DNA, 1807 bp, Artificial Sequence; identical to SEQ ID NO: 8089
  Synthetic polypeptide

SEQ ID NO: 12720 - DNA, 487 bp, Artificial Sequence
  Synthetic polypeptide
ggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcaggtgcggcaccttgctcccccgcagagcctccccgtgtgcgcactggtcctgtgcgttccaggcatccccagagcacgagcgtctcggggctggacccagatgcagctgcccgagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctag

SEQ ID NO: 12721 - DNA, 469 bp, Artificial Sequence
  Synthetic polypeptide
ggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacaggtacggagctggcttcgcgtggttccagggcgacttccgatttgtgcgggctggagatggaggacgaggacaccatcgacgtgttccagcagcagacgggaggtgtgccggagagcagcctggcagggcacagtttctagagggcccgtccccagcccgggccgtccatcctcgcattgctgttga

SEQ ID NO: 12722 - DNA, 373 bp, Artificial Sequence
  Synthetic polypeptide
ggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctag

SEQ ID NO: 12723 - DNA, 505 bp, Artificial Sequence
  Synthetic polypeptide
ggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagggcatcatactgtcatggaaagagctttggacctggaaacagacttttttttttgagacggagtctcgctttgttgcccaggctagaatgcagtggcgcagtctcagctcactgtgcaagctctgcctcctgagttcacgccattctcctgcctcagcctcccaagtagctgggactataggtgcccaccaccactcccggctaatttttttgtatttttag

SEQ ID NO: 12724 - DNA, 534 bp, Artificial Sequence; identical to SEQ ID NO: 8079
  Synthetic polypeptide

SEQ ID NO: 12725 - DNA, 500 bp, Artificial Sequence; identical to SEQ ID NO: 8080
  Synthetic polypeptide

SEQ ID NO: 12726 - DNA, 453 bp, Artificial Sequence; identical to SEQ ID NO: 8081
  Synthetic polypeptide

SEQ ID NO: 12727 - DNA, 1038 bp, Artificial Sequence; identical to SEQ ID NO: 12062
  Synthetic polypeptide

SEQ ID NO: 12728 - DNA, 742 bp, Artificial Sequence; identical to SEQ ID NO: 6357
  Synthetic polypeptide

SEQ ID NO: 12729 - DNA, 590 bp, Artificial Sequence; identical to SEQ ID NO: 6358
  Synthetic polypeptide

SEQ ID NO: 12730 - DNA, 577 bp, Artificial Sequence; identical to SEQ ID NO: 6359
  Synthetic polypeptide

SEQ ID NO: 12731 - DNA, 430 bp, Artificial Sequence; identical to SEQ ID NO: 6360
  Synthetic polypeptide

SEQ ID NO: 12732 - DNA, 670 bp, Artificial Sequence; identical to SEQ ID NO: 6361
  Synthetic polypeptide

SEQ ID NO: 12733 - DNA, 797 bp, Artificial Sequence
  Synthetic polypeptide
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 12734 - DNA, 192 bp, Artificial Sequence
  Synthetic polypeptide
aaaggtacaacttgctgggaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctag

SEQ ID NO: 12735 - DNA, 529 bp, Artificial Sequence
  Synthetic polypeptide
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 12736 - DNA, 1317 bp, Artificial Sequence
  Synthetic polypeptide
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaa

SEQ ID NO: 12737 - DNA, 1221 bp, Artificial Sequence
  Synthetic polypeptide
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctag

SEQ ID NO: 12738 - DNA, 1200 bp, Artificial Sequence
  Synthetic polypeptide
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctga

SEQ ID NO: 12739 - DNA, 922 bp, Artificial Sequence
  Synthetic polypeptide
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcagttaagcctgagcccttgccacacggatttccttctcacccgcttcctccccgcaccactctggggatcagaagtatcagtgccaagtggtccctttcatctcctcataattcttccccagccacttagtgggttagtcaggccctgccttctcttcagccagccctgcagtc

SEQ ID NO: 12740 - DNA, 632 bp, Artificial Sequence
  Synthetic polypeptide
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtcca

SEQ ID NO: 12741 - DNA, 441 bp, Artificial Sequence
  Synthetic polypeptide
gcgtggcaacagtgcagggatcccagggctggggagagacctgagctacgagagtacaagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctag

SEQ ID NO: 12742 - DNA, 558 bp, Artificial Sequence
  Synthetic polypeptide
gcgtggcaacagtgcagggatcccagggctggggagagacctgagctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctag

SEQ ID NO: 12743 - DNA, 492 bp, Artificial Sequence
  Synthetic polypeptide
gcgtggcaacagtgcagggatcccagggctggggagagacctgagctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccgcacaagccacgcttcaccaccaagaggcccaacaccttcttctag

SEQ ID NO: 12744 - DNA, 1549 bp, Artificial Sequence
  Synthetic polypeptide
gaccgggcgcagtggctcacgcctgtaatctcagcactttgggaggcctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtga

SEQ ID NO: 12745 - DNA, 845 bp, Artificial Sequence
  Synthetic polypeptide
gaccgggcgcagtggctcacgcctgtaatctcagcactttgggaggcctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggaca

SEQ ID NO: 12746 - DNA, 403 bp, Artificial Sequence
  Synthetic polypeptide
gaccgggcgcagtggctcacgcctgtaatctcagcactttgggaggcctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagttt

SEQ ID NO: 12747 - DNA, 331 bp, Artificial Sequence; identical to SEQ ID NO: 7504
  Synthetic polypeptide

SEQ ID NO: 12748 - DNA, 148 bp, Artificial Sequence; identical to SEQ ID NO: 6388
  Synthetic polypeptide

SEQ ID NO: 12749 - DNA, 1100 bp, Artificial Sequence; identical to SEQ ID NO: 6389
  Synthetic polypeptide

SEQ ID NO: 12750 - DNA, 464 bp, Artificial Sequence; identical to SEQ ID NO: 6390
  Synthetic polypeptide

SEQ ID NO: 12751 - DNA, 280 bp, Artificial Sequence; identical to SEQ ID NO: 6391
  Synthetic polypeptide

SEQ ID NO: 12752 - DNA, 1691 bp, Artificial Sequence; identical to SEQ ID NO: 12579
  Synthetic polypeptide

SEQ ID NO: 12753 - DNA, 522 bp, Artificial Sequence; identical to SEQ ID NO: 12580
  Synthetic polypeptide

SEQ ID NO: 12754 - DNA, 792 bp, Artificial Sequence; identical to SEQ ID NO: 6418
  Synthetic polypeptide

SEQ ID NO: 12755 - DNA, 369 bp, Artificial Sequence; identical to SEQ ID NO: 6419
  Synthetic polypeptide

SEQ ID NO: 12756 - DNA, 249 bp, Artificial Sequence; identical to SEQ ID NO: 6420
  Synthetic polypeptide

SEQ ID NO: 12757 - DNA, 369 bp, Artificial Sequence; identical to SEQ ID NO: 6421
  Synthetic polypeptide

SEQ ID NO: 12758 - DNA, 843 bp, Artificial Sequence; identical to SEQ ID NO: 6422
  Synthetic polypeptide

SEQ ID NO: 12759 - DNA, 116 bp, Artificial Sequence; identical to SEQ ID NO: 8185
  Synthetic polypeptide

SEQ ID NO: 12760 - DNA, 105 bp, Artificial Sequence; identical to SEQ ID NO: 8186
  Synthetic polypeptide

SEQ ID NO: 12761 - DNA, 1325 bp, Artificial Sequence; identical to SEQ ID NO: 7686
  Synthetic polypeptide

SEQ ID NO: 12762 - DNA, 1691 bp, Artificial Sequence; identical to SEQ ID NO: 7687
  Synthetic polypeptide

SEQ ID NO: 12763 - DNA, 1541 bp, Artificial Sequence; identical to SEQ ID NO: 7688
  Synthetic polypeptide

SEQ ID NO: 12764 - DNA, 379 bp, Artificial Sequence
  Synthetic polypeptide
ccaggcgcggtggctcacgcctgtaatcccagcactttgggaggccgaggcaggcagatcacctgagtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataa

SEQ ID NO: 12765 - DNA, 280 bp, Artificial Sequence
  Synthetic polypeptide
ccaggcgcggtggctcacgcctgtaatcccagcactttgggaggccgaggcaggcagatcacctgagtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtgtaa

SEQ ID NO: 12766 - DNA, 496 bp, Artificial Sequence; identical to SEQ ID NO: 11226
  Synthetic polypeptide

SEQ ID NO: 12767 - DNA, 385 bp, Artificial Sequence; identical to SEQ ID NO: 11229
  Synthetic polypeptide

SEQ ID NO: 12768 - DNA, 385 bp, Artificial Sequence; identical to SEQ ID NO: 11229
  Synthetic polypeptide

SEQ ID NO: 12769 - DNA, 386 bp, Artificial Sequence; identical to SEQ ID NO: 11224
  Synthetic polypeptide

SEQ ID NO: 12770 - DNA, 457 bp, Artificial Sequence; identical to SEQ ID NO: 11225
  Synthetic polypeptide

SEQ ID NO: 12771 - DNA, 1154 bp, Artificial Sequence; identical to SEQ ID NO: 8078
  Synthetic polypeptide

SEQ ID NO: 12772 - DNA, 385 bp, Artificial Sequence; identical to SEQ ID NO: 11229
  Synthetic polypeptide

SEQ ID NO: 12773 - DNA, 418 bp, Artificial Sequence; identical to SEQ ID NO: 11223
  Synthetic polypeptide

SEQ ID NO: 12774 - DNA, 418 bp, Artificial Sequence; identical to SEQ ID NO: 11223
  Synthetic polypeptide

SEQ ID NO: 12775 - DNA, 418 bp, Artificial Sequence; identical to SEQ ID NO: 11223
  Synthetic polypeptide

SEQ ID NO: 12776 - DNA, 418 bp, Artificial Sequence; identical to SEQ ID NO: 11223
  Synthetic polypeptide

SEQ ID NO: 12777 - DNA, 418 bp, Artificial Sequence; identical to SEQ ID NO: 11223
  Synthetic polypeptide

SEQ ID NO: 12778 - DNA, 851 bp, Artificial Sequence
  Synthetic polypeptide
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 12779 - DNA, 943 bp, Artificial Sequence; identical to SEQ ID NO: 9889
  Synthetic polypeptide

SEQ ID NO: 12780 - DNA, 418 bp, Artificial Sequence; identical to SEQ ID NO: 11223
  Synthetic polypeptide

SEQ ID NO: 12781 - DNA, 833 bp, Artificial Sequence
  Synthetic polypeptide
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 12782 - DNA, 815 bp, Artificial Sequence
  Synthetic polypeptide
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 12783 - DNA, 320 bp, Artificial Sequence; identical to SEQ ID NO: 8218
  Synthetic polypeptide

SEQ ID NO: 12784 - DNA, 485 bp, Artificial Sequence; identical to SEQ ID NO: 8219
  Synthetic polypeptide

SEQ ID NO: 12785 - DNA, 1516 bp, Artificial Sequence; identical to SEQ ID NO: 534
  Synthetic polypeptide

SEQ ID NO: 12786 - DNA, 591 bp, Artificial Sequence; identical to SEQ ID NO: 539
  Synthetic polypeptide

SEQ ID NO: 12787 - DNA, 482 bp, Artificial Sequence; identical to SEQ ID NO: 540
  Synthetic polypeptide

SEQ ID NO: 12788 - DNA, 444 bp, Artificial Sequence; identical to SEQ ID NO: 541
  Synthetic polypeptide

SEQ ID NO: 12789 - DNA, 334 bp, Artificial Sequence; identical to SEQ ID NO: 533
  Synthetic polypeptide

SEQ ID NO: 12790 - DNA, 38 bp, Artificial Sequence; identical to SEQ ID NO: 543
  Synthetic polypeptide

SEQ ID NO: 12791 - DNA, 245 bp, Artificial Sequence; identical to SEQ ID NO: 542
  Synthetic polypeptide

SEQ ID NO: 12792 - DNA, 330 bp, Artificial Sequence; identical to SEQ ID NO: 6490
  Synthetic polypeptide

SEQ ID NO: 12793 - DNA, 1629 bp, Artificial Sequence; identical to SEQ ID NO: 8070
  Synthetic polypeptide

SEQ ID NO: 12794 - DNA, 1500 bp, Artificial Sequence; identical to SEQ ID NO: 8071
  Synthetic polypeptide

SEQ ID NO: 12795 - DNA, 370 bp, Artificial Sequence; identical to SEQ ID NO: 6522
  Synthetic polypeptide

SEQ ID NO: 12796 - DNA, 568 bp, Artificial Sequence; identical to SEQ ID NO: 6787
  Synthetic polypeptide

SEQ ID NO: 12797 - DNA, 181 bp, Artificial Sequence; identical to SEQ ID NO: 6788
  Synthetic polypeptide

SEQ ID NO: 12798 - DNA, 871 bp, Artificial Sequence; identical to SEQ ID NO: 437
  Synthetic polypeptide

SEQ ID NO: 12799 - DNA, 421 bp, Artificial Sequence; identical to SEQ ID NO: 441
  Synthetic polypeptide

SEQ ID NO: 12800 - DNA, 638 bp, Artificial Sequence; identical to SEQ ID NO: 442
  Synthetic polypeptide

SEQ ID NO: 12801 - DNA, 337 bp, Artificial Sequence; identical to SEQ ID NO: 443
  Synthetic polypeptide

SEQ ID NO: 12802 - DNA, 1089 bp, Artificial Sequence; identical to SEQ ID NO: 8115
  Synthetic polypeptide

SEQ ID NO: 12803 - DNA, 408 bp, Artificial Sequence; identical to SEQ ID NO: 6882
  Synthetic polypeptide

SEQ ID NO: 12804 - DNA, 401 bp, Artificial Sequence; identical to SEQ ID NO: 6883
  Synthetic polypeptide

SEQ ID NO: 12805 - DNA, 510 bp, Artificial Sequence; identical to SEQ ID NO: 6884
  Synthetic polypeptide

SEQ ID NO: 12806 - DNA, 648 bp, Artificial Sequence
  Synthetic polypeptide
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaa

SEQ ID NO: 12807 - DNA, 405 bp, Artificial Sequence
  Synthetic polypeptide
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgggtgtgtccagcatcatggcctcctcccagtaacttcaggtgtttaataaagatgtgttga

SEQ ID NO: 12808 - DNA, 627 bp, Artificial Sequence
  Synthetic polypeptide
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgagtggtga

SEQ ID NO: 12809 - DNA, 411 bp, Artificial Sequence
  Synthetic polypeptide
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgggcttctctgttccgcttccttctcttaaatcgcatgtgctggctgggcatggtggctcacacctgt

SEQ ID NO: 12810 - DNA, 570 bp, Artificial Sequence
  Synthetic polypeptide
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaa

SEQ ID NO: 12811 - DNA, 2254 bp, Artificial Sequence; identical to SEQ ID NO: 8053
  Synthetic polypeptide

SEQ ID NO: 12812 - DNA, 2044 bp, Artificial Sequence; identical to SEQ ID NO: 8054
  Synthetic polypeptide

SEQ ID NO: 12813 - DNA, 1735 bp, Artificial Sequence; identical to SEQ ID NO: 8055
  Synthetic polypeptide

SEQ ID NO: 12814 - DNA, 206 bp, Artificial Sequence; identical to SEQ ID NO: 6759
  Synthetic polypeptide

SEQ ID NO: 12815 - DNA, 450 bp, Artificial Sequence
  Synthetic polypeptide
gtgcctgaggtcccagctactcgggaggatcacttgggcctgggagttcaaggctgcagtgagctgtgatcacatcactgcactccagctttggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctga

SEQ ID NO: 12816 - DNA, 186 bp, Artificial Sequence; identical to SEQ ID NO: 7638
  Synthetic polypeptide

SEQ ID NO: 12817 - DNA, 3458 bp, Artificial Sequence
  Synthetic polypeptide
tttggtgccgtgactcagaccgggggacctcccttgggagatcaatccctgtcctcctgttctttgctccatgagaaagatccacctatgacctcaggtcctcagacccaccagcccaaggaacatctcaccaattttaaatccggtaagcggcctcttcttactctcttctccaacctctctcactatccctcaaccactttctcctttccactcttccatctctcccttctcttaatttcaattcctttcattttctgatagagacaaaggagacctgttttatccgtggacccaaaactccagcaccagtcacggactgggaaggcagccttcccttggtgtttaatcattgcagggacacctctctgattattcacccacgtttcagaggtgtcagaccatgcagggacacctgccttggtccttcacccttagtggcaagtcccgcttttctgggggaggggcaagtaccccaaccccttctctccatgtctctactccttctccacctttctggggggcaagaaacccccaaccccttctccttcacccttagtggcaagtcctgcttttctaggggaggggcaagtagcccaacctcgtatctctgtgccccgaacccttatttccacgccccaacaccttatatctctgtgccccaatcccttatttctgtgccccaacctcttatacctctgcgccccaatcccttatttccatgcccctatcttgtatctctgtgcccctacccctttcccacttttctggagggtaagaacccccgaaccccttccctccgtgtctctactctcttctctgggcttgcctccttcactatgggcaaccttccaccttccattcctccttctccctcagcctatgttcttaagaacttaaatcctcttcaactctcacctgacctaaaatccaagtgtcttattttcttctgtaatgccgcttgaccccaatacaaactcgacagtagttccaaatagccagaaaatggcactttcaatttttccatcctacaagatctaaataattcttgtcgtaaaataggcaaatggtctgaggtgcctgacagccaggcattcttttacacatcagtccctctctagtctctgttcccaatgcagcttatcccaaatcttccttctttctctcccacctgccccctcagtcccaaccccaagcgcctctgagtcttcctaatcttccttttctacagacccatctgacctctcccctcctccccaggctgctccttgccaggccaagctaggtcccaattcttcctcagcctctgctcctccaccctataatccttttatcacctctcctcctcacacctggtctggcttacagttttgttccgtgactagccctcccccacctgcccagcaatttactcttaaaaaggtggctgaagctaaaggcatagtcaagattaatgctcctttttctttatcagacctctcccaaatcagtgagcatttaggctctttcatcaaatatgaaaaacccagcccagttcatgacttgtttggcagcaaccctgagacgctttacagcctagaccctaaaaggtcaaaaggccatcttattctcaatatacactttattgcccaatctgctcccgacattaaataaaactccaaaaattaaattccggccctcaaaccccacaacaggatttaattaacctcgccttcaaggtgtacaataatagaaaacagttgcaattccttgcctccactgtgagacaaaccccagtcacatctccagcacacaagaacttccaaacgcctgaaccgcagtggccaggtgttcctccagaacctcctcccccaggagcttgctacaagtgccagaaatctggccaccaggccaaagaatgcctgcagcccaggtttcctcctaagccacatcccatctgtgcgggaccccactggaaatcagactgtccaactcacctggcagccactcccagagcccctggaactctggcccaaggctctctgactccttcccagatcttcttggcttagcggctgaagactgacgctgcccgattgccttgcaagccccctcgaccatcacggacgctgagcttcgggtaactctcacagtggagggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactga

SEQ ID NO: 12818 - DNA, 921 bp, Artificial Sequence
  Synthetic polypeptide
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 12819 - DNA, 330 bp, Artificial Sequence
  Synthetic polypeptide
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaaggggtaa

SEQ ID NO: 12820 - DNA, 930 bp, Artificial Sequence
  Synthetic polypeptide
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 12821 - DNA, 879 bp, Artificial Sequence
  Synthetic polypeptide
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 12822 - DNA, 870 bp, Artificial Sequence
  Synthetic polypeptide
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 12823 - DNA, 752 bp, Artificial Sequence
  Synthetic polypeptide
cctccaggtgagatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatga

SEQ ID NO: 12824 - DNA, 740 bp, Artificial Sequence
  Synthetic polypeptide
cctccaggtgagatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagataatgcagaagggtgatgctgttctccagcactccatcagtgcaatctactggccaatgacaaggtggttaaaatgtcctttagtagatgaatcagcagatggctggcatgagtatcagtag

SEQ ID NO: 12825 - DNA, 2157 bp, Artificial Sequence; identical to SEQ ID NO: 6426
  Synthetic polypeptide

SEQ ID NO: 12826 - DNA, 799 bp, Artificial Sequence; identical to SEQ ID NO: 6427
  Synthetic polypeptide

SEQ ID NO: 12827 - DNA, 336 bp, Artificial Sequence; identical to SEQ ID NO: 6428
  Synthetic polypeptide

SEQ ID NO: 12828 - DNA, 374 bp, Artificial Sequence; identical to SEQ ID NO: 8117
  Synthetic polypeptide

SEQ ID NO: 12829 - DNA, 595 bp, Artificial Sequence
  Synthetic polypeptide
agaggggatgatttgaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctga

SEQ ID NO: 12830 - DNA, 618 bp, Artificial Sequence
  Synthetic polypeptide
ttccagtgtcagccctgcccttctagccgaatcacctctgggcaagtctcgtgaccttcctaacctcatttatctcacctgtataatgggctaataatacctagtaccctgggaagtctggcagggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaagtctgagtcagcccatcctgttgggagccctggagagagtggcacatcagggtggcgagggggggacactcccagccccctctgtctcttgctattactgctgcttctgattcttcgtcttctgcgaattctgtga

SEQ ID NO: 12831 - DNA, 594 bp, Artificial Sequence
  Synthetic polypeptide
ttccagtgtcagccctgcccttctagccgaatcacctctgggcaagtctcgtgaccttcctaacctcatttatctcacctgtataatgggctaataatacctagtaccctgggaagtctggcagggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaaccttccctctcatcccaaggagccagagtcctcccaagatcccctggaggaggagggatccctgctgcctgcactgggggtgccaattcagaccgacaagatggagcattga

SEQ ID NO: 12832 - DNA, 636 bp, Artificial Sequence
  Synthetic polypeptide
ttccagtgtcagccctgcccttctagccgaatcacctctgggcaagtctcgtgaccttcctaacctcatttatctcacctgtataatgggctaataatacctagtaccctgggaagtctggcagggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggagagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaa

SEQ ID NO: 12833 - DNA, 471 bp, Artificial Sequence
  Synthetic polypeptide
ggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtga

SEQ ID NO: 12834 - DNA, 519 bp, Artificial Sequence
  Synthetic polypeptide
ggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtga

SEQ ID NO: 12835 - DNA, 293 bp, Artificial Sequence
  Synthetic polypeptide
ggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccg

SEQ ID NO: 12836 - DNA, 168 bp, Artificial Sequence
  Synthetic polypeptide
ggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggc

SEQ ID NO: 12837 - DNA, 126 bp, Artificial Sequence
  Synthetic polypeptide
ggccaggtgcggtggctcacgcctgtaatcccagcactccgggaggccgaggcaggcggatcacttgaggaggagaagatgaggaaggaagaggaagaggccaagaagcgggcagaggatgatgcc

SEQ ID NO: 12838 - DNA, 1089 bp, Artificial Sequence; identical to SEQ ID NO: 8101
  Synthetic polypeptide

SEQ ID NO: 12839 - DNA, 1224 bp, Artificial Sequence; identical to SEQ ID NO: 6690
  Synthetic polypeptide

SEQ ID NO: 12840 - DNA, 588 bp, Artificial Sequence; identical to SEQ ID NO: 6349
  Synthetic polypeptide

SEQ ID NO: 12841 - DNA, 1376 bp, Artificial Sequence; identical to SEQ ID NO: 6350
  Synthetic polypeptide

SEQ ID NO: 12842 - DNA, 1280 bp, Artificial Sequence; identical to SEQ ID NO: 6351
  Synthetic polypeptide

SEQ ID NO: 12843 - DNA, 1259 bp, Artificial Sequence; identical to SEQ ID NO: 6352
  Synthetic polypeptide

SEQ ID NO: 12844 - DNA, 981 bp, Artificial Sequence; identical to SEQ ID NO: 6353
  Synthetic polypeptide

SEQ ID NO: 12845 - DNA, 691 bp, Artificial Sequence; identical to SEQ ID NO: 6354
  Synthetic polypeptide

SEQ ID NO: 12846 - DNA, 382 bp, Artificial Sequence; identical to SEQ ID NO: 434
  Synthetic polypeptide

SEQ ID NO: 12847 - DNA, 295 bp, Artificial Sequence; identical to SEQ ID NO: 8323
  Synthetic polypeptide

SEQ ID NO: 12848 - DNA, 1117 bp, Artificial Sequence; identical to SEQ ID NO: 8324
  Synthetic polypeptide

SEQ ID NO: 12849 - DNA, 931 bp, Artificial Sequence; identical to SEQ ID NO: 8325
  Synthetic polypeptide

SEQ ID NO: 12850 - DNA, 220 bp, Artificial Sequence; identical to SEQ ID NO: 7991
  Synthetic polypeptide

SEQ ID NO: 12851 - DNA, 334 bp, Artificial Sequence; identical to SEQ ID NO: 7992
  Synthetic polypeptide

SEQ ID NO: 12852 - DNA, 828 bp, Artificial Sequence
  Synthetic polypeptide
tgataatgttgacttttacccaagccctgtgatcctggaaaactaaggcttaagaaatgccttcccactgttttgtgttctggaacacagcatattgcaaaaaaacatccttccccaagtgagttaggtaagactggtgtatgcccctctggttcaccaatgacaaagccagacacagactccatattccaaatctcctcatgaaagctttgaggaacttcttgtccccactgatcagttggaacaaactttggttaaaacttctctccttcccccagcttcccgaactttggcttaccctcagcttgagccagcgcacatctcctccttaacagcctctcctgagaataggctggcttcaagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggac

SEQ ID NO: 12853 - DNA, 1278 bp, Artificial Sequence
  Synthetic polypeptide
tgataatgttgacttttacccaagccctgtgatcctggaaaactaaggcttaagaaatgccttcccactgttttgtgttctggaacacagcatattgcaaaaaaacatccttccccaagtgagttaggtaagactggtgtatgcccctctggttcaccaatgacaaagccagacacagactccatattccaaatctcctcatgaaagctttgaggaacttcttgtccccactgatcagttggaacaaactttggttaaaacttctctccttcccccagcttcccgaactttggcttaccctcagcttgagccagcgcacatctcctccttaacagcctctcctgagaataggctggcttcaagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactag

SEQ ID NO: 12854 - DNA, 443 bp, Artificial Sequence
  Synthetic polypeptide
gctgggcacagtggctcacacctgtaatcccagcactctgggaggccaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactga

SEQ ID NO: 12855 - DNA, 350 bp, Artificial Sequence
  Synthetic polypeptide
gctgggcacagtggctcacacctgtaatcccagcactctgggaggccaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggttcattgcaaccagtga

SEQ ID NO: 12856 - DNA, 272 bp, Artificial Sequence; identical to SEQ ID NO: 8166
  Synthetic polypeptide

SEQ ID NO: 12857 - DNA, 89 bp, Artificial Sequence; identical to SEQ ID NO: 8167
  Synthetic polypeptide

SEQ ID NO: 12858 - DNA, 223 bp, Artificial Sequence; identical to SEQ ID NO: 8168
  Synthetic polypeptide

SEQ ID NO: 12859 - DNA, 427 bp, Artificial Sequence; identical to SEQ ID NO: 573
  Synthetic polypeptide

SEQ ID NO: 12860 - DNA, 1004 bp, Artificial Sequence; identical to SEQ ID NO: 8920
  Synthetic polypeptide

SEQ ID NO: 12861 - DNA, 887 bp, Artificial Sequence; identical to SEQ ID NO: 8921
  Synthetic polypeptide

SEQ ID NO: 12862 - DNA, 1138 bp, Artificial Sequence; identical to SEQ ID NO: 7655
  Synthetic polypeptide

SEQ ID NO: 12863 - DNA, 418 bp, Artificial Sequence; identical to SEQ ID NO: 8331
  Synthetic polypeptide

SEQ ID NO: 12864 - DNA, 488 bp, Artificial Sequence; identical to SEQ ID NO: 8332
  Synthetic polypeptide

SEQ ID NO: 12865 - DNA, 563 bp, Artificial Sequence; identical to SEQ ID NO: 8333
  Synthetic polypeptide

SEQ ID NO: 12866 - DNA, 739 bp, Artificial Sequence; identical to SEQ ID NO: 8334
  Synthetic polypeptide

SEQ ID NO: 12867 - DNA, 415 bp, Artificial Sequence; identical to SEQ ID NO: 8335
  Synthetic polypeptide

SEQ ID NO: 12868 - DNA, 478 bp, Artificial Sequence; identical to SEQ ID NO: 8336
  Synthetic polypeptide

SEQ ID NO: 12869 - DNA, 609 bp, Artificial Sequence; identical to SEQ ID NO: 8108
  Synthetic polypeptide

SEQ ID NO: 12870 - DNA, 320 bp, Artificial Sequence; identical to SEQ ID NO: 8109
  Synthetic polypeptide

SEQ ID NO: 12871 - DNA, 1047 bp, Artificial Sequence; identical to SEQ ID NO: 8738
  Synthetic polypeptide

SEQ ID NO: 12872 - DNA, 1926 bp, Artificial Sequence; identical to SEQ ID NO: 9669
  Synthetic polypeptide

SEQ ID NO: 12873 - DNA, 2439 bp, Artificial Sequence; identical to SEQ ID NO: 9670
  Synthetic polypeptide

SEQ ID NO: 12874 - DNA, 2481 bp, Artificial Sequence; identical to SEQ ID NO: 9671
  Synthetic polypeptide

SEQ ID NO: 12875 - DNA, 32 bp, Artificial Sequence
  Synthetic polypeptide
agtgcttggcctctggggcctgcagaggctga

SEQ ID NO: 12876 - DNA, 331 bp, Artificial Sequence
  Synthetic polypeptide
agtgcttggcctctggggcctgcagaggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtga

SEQ ID NO: 12877 - DNA, 299 bp, Artificial Sequence; identical to SEQ ID NO: 485
  Synthetic polypeptide

SEQ ID NO: 12878 - DNA, 682 bp, Artificial Sequence; identical to SEQ ID NO: 9078
  Synthetic polypeptide

SEQ ID NO: 12879 - DNA, 78 bp, Artificial Sequence; identical to SEQ ID NO: 9079
  Synthetic polypeptide

SEQ ID NO: 12880 - DNA, 481 bp, Artificial Sequence; identical to SEQ ID NO: 9080
  Synthetic polypeptide

SEQ ID NO: 12881 - DNA, 292 bp, Artificial Sequence; identical to SEQ ID NO: 9081
  Synthetic polypeptide

SEQ ID NO: 12882 - DNA, 236 bp, Artificial Sequence; identical to SEQ ID NO: 9082
  Synthetic polypeptide

SEQ ID NO: 12883 - DNA, 682 bp, Artificial Sequence; identical to SEQ ID NO: 9083
  Synthetic polypeptide

SEQ ID NO: 12884 - DNA, 347 bp, Artificial Sequence; identical to SEQ ID NO: 9084
  Synthetic polypeptide

SEQ ID NO: 12885 - DNA, 273 bp, Artificial Sequence; identical to SEQ ID NO: 9085
  Synthetic polypeptide

SEQ ID NO: 12886 - DNA, 317 bp, Artificial Sequence; identical to SEQ ID NO: 9086
  Synthetic polypeptide

SEQ ID NO: 12887 - DNA, 369 bp, Artificial Sequence; identical to SEQ ID NO: 9087
  Synthetic polypeptide

SEQ ID NO: 12888 - DNA, 175 bp, Artificial Sequence; identical to SEQ ID NO: 9088
  Synthetic polypeptide

SEQ ID NO: 12889 - DNA, 493 bp, Artificial Sequence; identical to SEQ ID NO: 12530
  Synthetic polypeptide

SEQ ID NO: 12890 - DNA, 2672 bp, Artificial Sequence; identical to SEQ ID NO: 6621
  Synthetic polypeptide

SEQ ID NO: 12891 - DNA, 1767 bp, Artificial Sequence; identical to SEQ ID NO: 6622
  Synthetic polypeptide

SEQ ID NO: 12892 - DNA, 1692 bp, Artificial Sequence; identical to SEQ ID NO: 6623
  Synthetic polypeptide

SEQ ID NO: 12893 - DNA, 3243 bp, Artificial Sequence
  Synthetic polypeptide
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctga

SEQ ID NO: 12894 - DNA, 878 bp, Artificial Sequence
  Synthetic polypeptide
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctggg

SEQ ID NO: 12895 - DNA, 545 bp, Artificial Sequence
  Synthetic polypeptide
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttcca

SEQ ID NO: 12896 - DNA, 877 bp, Artificial Sequence
  Synthetic polypeptide
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgg

SEQ ID NO: 12897 - DNA, 498 bp, Artificial Sequence
  Synthetic polypeptide
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtc

SEQ ID NO: 12898 - DNA, 615 bp, Artificial Sequence
  Synthetic polypeptide
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggc

SEQ ID NO: 12899 - DNA, 773 bp, Artificial Sequence; identical to SEQ ID NO: 10251
  Synthetic polypeptide

SEQ ID NO: 12900 - DNA, 171 bp, Artificial Sequence; identical to SEQ ID NO: 6873
  Synthetic polypeptide

SEQ ID NO: 12901 - DNA, 633 bp, Artificial Sequence; identical to SEQ ID NO: 6874
  Synthetic polypeptide

SEQ ID NO: 12902 - DNA, 636 bp, Artificial Sequence; identical to SEQ ID NO: 6875
  Synthetic polypeptide

SEQ ID NO: 12903 - DNA, 480 bp, Artificial Sequence; identical to SEQ ID NO: 6876
  Synthetic polypeptide

SEQ ID NO: 12904 - DNA, 254 bp, Artificial Sequence; identical to SEQ ID NO: 6870
  Synthetic polypeptide

SEQ ID NO: 12905 - DNA, 415 bp, Artificial Sequence; identical to SEQ ID NO: 6871
  Synthetic polypeptide

SEQ ID NO: 12906 - DNA, 580 bp, Artificial Sequence; identical to SEQ ID NO: 6872
  Synthetic polypeptide

SEQ ID NO: 12907 - DNA, 1267 bp, Artificial Sequence; identical to SEQ ID NO: 463
  Synthetic polypeptide

SEQ ID NO: 12908 - DNA, 104 bp, Artificial Sequence
  Synthetic polypeptide
ggccgggcacggtggctcacgcctgtaatcccagccctttgagaggctgaggcagccacctggcccagtgcttggccgaaagcacagaagacgtgacgtggtga

SEQ ID NO: 12909 - DNA, 149 bp, Artificial Sequence
  Synthetic polypeptide
ggccgggcacggtggctcacgcctgtaatcccagccctttgagaggctgaggcagccacctggcccagtgcttggccgaaagcacagaagacgtgacgtgtctttcatggatgtgcaagactttgaatgaccctggcagtcaagggtga

SEQ ID NO: 12910 - DNA, 413 bp, Artificial Sequence
  Synthetic polypeptide
ggccgagtagtggagaaagagtgcctgggagtcaggagtcctgggcgctgccgctgacttcctggcgtccctgagtgagtccatttccctcccaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctag

SEQ ID NO: 12911 - DNA, 320 bp, Artificial Sequence
  Synthetic polypeptide
ggccgagtagtggagaaagagtgcctgggagtcaggagtcctgggcgctgccgctgacttcctggcgtccctgagtgagtccatttccctcccaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtga

SEQ ID NO: 12912 - DNA, 380 bp, Artificial Sequence
  Synthetic polypeptide
ggccgagtagtggagaaagagtgcctgggagtcaggagtcctgggcgctgccgctgacttcctggcgtccctgagtgagtccatttccctcccaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttag

SEQ ID NO: 12913 - DNA, 259 bp, Artificial Sequence; identical to SEQ ID NO: 7895
  Synthetic polypeptide

SEQ ID NO: 12914 - DNA, 310 bp, Artificial Sequence; identical to SEQ ID NO: 7896
  Synthetic polypeptide

SEQ ID NO: 12915 - DNA, 343 bp, Artificial Sequence
  Synthetic polypeptide
aaggcagagggcctggggacaagccagcctggacatgactcctctgctgcttattaattccttacctgaactactcttgggacctcgattccttcatgggcaaaatggtcacataatagcaccatcacaagacttgccaggaatctagagcaagaggataacgtctaaagcatctagctcaggtcctcacatctggaagggtgaaacttcctacatccgagtttatcctgagagaagcaccagctatggctactcacggtctcggtctgggtcaaggggccgtgactctccataccaaagcaggggttccccacactacttctctcctttcaggccctactga

SEQ ID NO: 12916 - DNA, 1473 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactga

SEQ ID NO: 12917 - DNA, 1446 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactga

SEQ ID NO: 12918 - DNA, 1181 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatggtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgatta

SEQ ID NO: 12919 - DNA, 921 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttcccc

SEQ ID NO: 12920 - DNA, 360 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggggtcatctgagggacgagatttcagagtga

SEQ ID NO: 12921 - DNA, 366 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggtatgctga

SEQ ID NO: 12922 - DNA, 715 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctc

SEQ ID NO: 12923 - DNA, 671 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcg

SEQ ID NO: 12924 - DNA, 363 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggttggattgatctctgaaagagaactatcctga

SEQ ID NO: 12925 - DNA, 339 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggtatgctga

SEQ ID NO: 12926 - DNA, 354 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggagtctatgatgtggtggagttga

SEQ ID NO: 12927 - DNA, 494 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctacc

SEQ ID NO: 12928 - DNA, 488 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaact

SEQ ID NO: 12929 - DNA, 472 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtcc

SEQ ID NO: 12930 - DNA, 363 bp, Artificial Sequence
  Synthetic polypeptide
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggcagggtcatctgagggacgagatttcagagtga

SEQ ID NO: 12931 - DNA, 289 bp, Artificial Sequence; identical to SEQ ID NO: 7343
  Synthetic polypeptide

SEQ ID NO: 12932 - DNA, 246 bp, Artificial Sequence; identical to SEQ ID NO: 7344
  Synthetic polypeptide

SEQ ID NO: 12933 - DNA, 149 bp, Artificial Sequence; identical to SEQ ID NO: 7345
  Synthetic polypeptide

SEQ ID NO: 12934 - DNA, 89 bp, Artificial Sequence; identical to SEQ ID NO: 7346
  Synthetic polypeptide

SEQ ID NO: 12935 - DNA, 80 bp, Artificial Sequence; identical to SEQ ID NO: 7347
  Synthetic polypeptide

SEQ ID NO: 12936 - DNA, 1185 bp, Artificial Sequence; identical to SEQ ID NO: 8800
  Synthetic polypeptide

SEQ ID NO: 12937 - DNA, 550 bp, Artificial Sequence; identical to SEQ ID NO: 8801
  Synthetic polypeptide

SEQ ID NO: 12938 - DNA, 387 bp, Artificial Sequence; identical to SEQ ID NO: 8802
  Synthetic polypeptide

SEQ ID NO: 12939 - DNA, 1713 bp, Artificial Sequence; identical to SEQ ID NO: 8803
  Synthetic polypeptide

SEQ ID NO: 12940 - DNA, 1950 bp, Artificial Sequence; identical to SEQ ID NO: 8804
  Synthetic polypeptide

SEQ ID NO: 12941 - DNA, 80 bp, Artificial Sequence; identical to SEQ ID NO: 6364
  Synthetic polypeptide

SEQ ID NO: 12942 - DNA, 217 bp, Artificial Sequence; identical to SEQ ID NO: 6365
  Synthetic polypeptide

SEQ ID NO: 12943 - DNA, 2309 bp, Artificial Sequence; identical to SEQ ID NO: 7608
  Synthetic polypeptide

SEQ ID NO: 12944 - DNA, 2389 bp, Artificial Sequence; identical to SEQ ID NO: 7609
  Synthetic polypeptide

SEQ ID NO: 12945 - DNA, 742 bp, Artificial Sequence; identical to SEQ ID NO: 8179
  Synthetic polypeptide

SEQ ID NO: 12946 - DNA, 430 bp, Artificial Sequence; identical to SEQ ID NO: 8180
  Synthetic polypeptide

SEQ ID NO: 12947 - DNA, 1329 bp, Artificial Sequence
  Synthetic polypeptide
gaaatgactagtctgatagaacagtgaatgacttactgaagattctgttacaataccagttatgagacaatatcatgaaatgtttggtttctcccttacaggctaccataagccatgaatcaatgaccagtatggtgtcatttctcacaagccagaatagatgggtccagaaatcatcaaaggcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaa

SEQ ID NO: 12948 - DNA, 1368 bp, Artificial Sequence
  Synthetic polypeptide
gaaatgactagtctgatagaacagtgaatgacttactgaagattctgttacaataccagttatgagacaatatcatgaaatgtttggtttctcccttacaggctaccataagccatgaatcaatgaccagtatggtgtcatttctcacaagccagaatagatgggtccagaaatcatcaaaggcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaa

SEQ ID NO: 12949 - DNA, 2582 bp, Artificial Sequence; identical to SEQ ID NO: 12600
  Synthetic polypeptide

SEQ ID NO: 12950 - DNA, 353 bp, Artificial Sequence; identical to SEQ ID NO: 12601
  Synthetic polypeptide

SEQ ID NO: 12951 - DNA, 142 bp, Artificial Sequence; identical to SEQ ID NO: 12602
  Synthetic polypeptide

SEQ ID NO: 12952 - DNA, 66 bp, Artificial Sequence; identical to SEQ ID NO: 12603
  Synthetic polypeptide

SEQ ID NO: 12953 - DNA, 2448 bp, Artificial Sequence; identical to SEQ ID NO: 6618
  Synthetic polypeptide

SEQ ID NO: 12954 - DNA, 1543 bp, Artificial Sequence; identical to SEQ ID NO: 6619
  Synthetic polypeptide

SEQ ID NO: 12955 - DNA, 1468 bp, Artificial Sequence; identical to SEQ ID NO: 6620
  Synthetic polypeptide

SEQ ID NO: 12956 - DNA, 1023 bp, Artificial Sequence; identical to SEQ ID NO: 611
  Synthetic polypeptide

SEQ ID NO: 12957 - DNA, 893 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 12958 - DNA, 959 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 12959 - DNA, 1028 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 12960 - DNA, 887 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 12961 - DNA, 920 bp, Artificial Sequence; identical to SEQ ID NO: 8111
  Synthetic polypeptide

SEQ ID NO: 12962 - DNA, 597 bp, Artificial Sequence
  Synthetic polypeptide
taggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtga

SEQ ID NO: 12963 - DNA, 543 bp, Artificial Sequence
  Synthetic polypeptide
taggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtga

SEQ ID NO: 12964 - DNA, 405 bp, Artificial Sequence
  Synthetic polypeptide
taggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcgtga

SEQ ID NO: 12965 - DNA, 1101 bp, Artificial Sequence; identical to SEQ ID NO: 8142
  Synthetic polypeptide

SEQ ID NO: 12966 - DNA, 1896 bp, Artificial Sequence; identical to SEQ ID NO: 8143
  Synthetic polypeptide

SEQ ID NO: 12967 - DNA, 1662 bp, Artificial Sequence; identical to SEQ ID NO: 8144
  Synthetic polypeptide

SEQ ID NO: 12968 - DNA, 1848 bp, Artificial Sequence
  Synthetic polypeptide
ggaatacttcttccccactcctgatgtttcctgtggctagagggaatactttggtgtaacacccgggctctcttcaccctccctgatgggcgtgtttgggagcaggaactcacgtgtgtagctgtgttccttcccccttttcctcttggacagagctgccctgagggtggtctcctgtgcagttaagtctcacctgagcagctccatgggagggggcttgcccctggcccgcactgcctgtgactgggtgggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactaa

SEQ ID NO: 12969 - DNA, 629 bp, Artificial Sequence; identical to SEQ ID NO: 7943
  Synthetic polypeptide

SEQ ID NO: 12970 - DNA, 472 bp, Artificial Sequence; identical to SEQ ID NO: 7944
  Synthetic polypeptide

SEQ ID NO: 12971 - DNA, 348 bp, Artificial Sequence
  Synthetic polypeptide
taaatttactgtagcctaagtgtacagtacttatgaagtctgtagtagtatagtaatgcattaggccttcacattcactcaccactcacttaccaactcacacagagcaatttccagtcctgcagactccattcatcgtgagtgccctatacagatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccagacatggtctccactatgttgcccaggctgaagtgcagtggctgttcatag

SEQ ID NO: 12972 - DNA, 489 bp, Artificial Sequence
  Synthetic polypeptide
taaatttactgtagcctaagtgtacagtacttatgaagtctgtagtagtatagtaatgcattaggccttcacattcactcaccactcacttaccaactcacacagagcaatttccagtcctgcagactccattcatcgtgagtgccctatacagatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaa

SEQ ID NO: 12973 - DNA, 419 bp, Artificial Sequence
  Synthetic polypeptide
taaatttactgtagcctaagtgtacagtacttatgaagtctgtagtagtatagtaatgcattaggccttcacattcactcaccactcacttaccaactcacacagagcaatttccagtcctgcagactccattcatcgtgagtgccctatacagatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagat

SEQ ID NO: 12974 - DNA, 518 bp, Artificial Sequence
  Synthetic polypeptide
gttgcgccgccccggccaagcctcagcctttctgggccttagcttcttcacgtgtagtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 12975 - DNA, 419 bp, Artificial Sequence
  Synthetic polypeptide
gttgcgccgccccggccaagcctcagcctttctgggccttagcttcttcacgtgtagtatacctgaggtgcaccggaggtgaagtcggtgccacttctgccctggcccccaagatcggccccctgggtctgattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 12976 - DNA, 330 bp, Artificial Sequence; identical to SEQ ID NO: 7604
  Synthetic polypeptide

SEQ ID NO: 12977 - DNA, 1133 bp, Artificial Sequence; identical to SEQ ID NO: 7332
  Synthetic polypeptide

SEQ ID NO: 12978 - DNA, 1172 bp, Artificial Sequence; identical to SEQ ID NO: 7333
  Synthetic polypeptide

SEQ ID NO: 12979 - DNA, 207 bp, Artificial Sequence; identical to SEQ ID NO: 7693
  Synthetic polypeptide

SEQ ID NO: 12980 - DNA, 268 bp, Artificial Sequence; identical to SEQ ID NO: 7694
  Synthetic polypeptide

SEQ ID NO: 12981 - DNA, 336 bp, Artificial Sequence; identical to SEQ ID NO: 7520
  Synthetic polypeptide

SEQ ID NO: 12982 - DNA, 346 bp, Artificial Sequence; identical to SEQ ID NO: 7521
  Synthetic polypeptide

SEQ ID NO: 12983 - DNA, 266 bp, Artificial Sequence
  Synthetic polypeptide
ggctgggcccagtagctcgtgcctgtaatcccagcattttggtaggctgaggcgggtggatggctcgagctcaggagttcgagagcagcctggaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctag

SEQ ID NO: 12984 - DNA, 491 bp, Artificial Sequence
  Synthetic polypeptide
ggaggggaggttaagggaaggagagggatgctgcagccggagggcccccaggcctcggaggaggggggcccccggaggagaggacagactgcatcatctgctgctcggcctatgacctctccgggcacctgccccgccgcctctactgtggacacaccttctgccaggcgtgtgtgcggcggctggacacaccggcgcccgagcagcgctggatcccctgtccgcagtgccgtcagagcacgcccacgcctcgcggaggggtggccatgctagacctggacctggctgctttcctggcggtcaaggctgagcgggagccggcaagactagaacccctgcccctcacctccctcaaaggcagcgccatcactcggcagccagctgggctgtgccctgccctgggaccccagccccacttcccccagcccagatactgctgctggggctgtggcagcctctgctgcccacccctaggcagccccgaggtctga

SEQ ID NO: 12985 - DNA, 887 bp, Artificial Sequence
  Synthetic polypeptide
agggaggctcagcagatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaa

SEQ ID NO: 12986 - DNA, 544 bp, Artificial Sequence
  Synthetic polypeptide
accctgtttttgttccctgcctcatgcctgactgatcatcttgcccttctgccaacataacttatcttgccagctaggcagggagctccctgcagcctggaactgtgaggctgtcttgtttcacttggcatttcccatgcctggcagagacatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaa

SEQ ID NO: 12987 - DNA, 393 bp, Artificial Sequence
  Synthetic polypeptide
accctgtttttgttccctgcctcatgcctgactgatcatcttgcccttctgccaacataacttatcttgccagctaggcagggagctccctgcagcctggaactgtgaggctgtcttgtttcacttggcatttcccatgcctggcagagacatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgca

SEQ ID NO: 12988 - DNA, 544 bp, Artificial Sequence; identical to SEQ ID NO: 12986
  Synthetic polypeptide

SEQ ID NO: 12989 - DNA, 526 bp, Artificial Sequence; identical to SEQ ID NO: 10237
  Synthetic polypeptide

SEQ ID NO: 12990 - DNA, 1314 bp, Artificial Sequence; identical to SEQ ID NO: 10238
  Synthetic polypeptide

SEQ ID NO: 12991 - DNA, 1218 bp, Artificial Sequence; identical to SEQ ID NO: 10239
  Synthetic polypeptide

SEQ ID NO: 12992 - DNA, 1197 bp, Artificial Sequence; identical to SEQ ID NO: 10240
  Synthetic polypeptide

SEQ ID NO: 12993 - DNA, 919 bp, Artificial Sequence; identical to SEQ ID NO: 10241
  Synthetic polypeptide

SEQ ID NO: 12994 - DNA, 629 bp, Artificial Sequence; identical to SEQ ID NO: 10242
  Synthetic polypeptide

SEQ ID NO: 12995 - DNA, 809 bp, Artificial Sequence; identical to SEQ ID NO: 8505
  Synthetic polypeptide

SEQ ID NO: 12996 - DNA, 809 bp, Artificial Sequence; identical to SEQ ID NO: 8506
  Synthetic polypeptide

SEQ ID NO: 12997 - DNA, 564 bp, Artificial Sequence; identical to SEQ ID NO: 8405
  Synthetic polypeptide

SEQ ID NO: 12998 - DNA, 74 bp, Artificial Sequence; identical to SEQ ID NO: 7010
  Synthetic polypeptide

SEQ ID NO: 12999 - DNA, 602 bp, Artificial Sequence
  Synthetic polypeptide
gggggaggagccaagatggccgaataggaacagctccggtctacagctcccagcgtgagcgacgcagaagacgggtgatttctgcatttccatctgagtttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtga

SEQ ID NO: 13000 - DNA, 569 bp, Artificial Sequence
  Synthetic polypeptide
ggccggacgcggtggctcacgcctgtaatcccagcactttgggagaccgaggcgggcagatcacgaggtcaggagatcgagaccatcctggctaacaagcactgtccatctatgccttgctacttttcgagatcgagacaggcgcagcagctgcttccatcctcggctcgggcaccctggttctggtggctgtgctgacccacactctcctccgggctgcccgggctgcccgccgtgggctccatgagttgtccccgccatcctttgaagacgacctcgcccgccctgccgaagtctccaaggccagccccagagctcagcctcagcagggtatccatcgtcggaccccctattcaacctgtccagagcctggggacccctttgggtccatggccactgccacagcacctgcagccctggagggaggctgggagagcagcctgcctgcatccagaatgcaccggacactgtcggctggcctggggcactgggacggggttacgcacgagatgcgtcgaatgctgggccacagaccagggagcatggggaaggactccacactggtgtga

SEQ ID NO: 13001 - DNA, 416 bp, Artificial Sequence
  Synthetic polypeptide
ggccggacgcggtggctcacgcctgtaatcccagcactttgggagaccgaggcgggcagatcacgaggtcaggagatcgagaccatcctggctaacaagcactgtccatctatgccttgctacttttcgagatcgagacaggcgcagcagctgcttccatcctcggctcgggcaccctggttctggtggctgtgctgacccacactctcctccgggctgcccgggctgcccgccgtgggctccatgagttgtccccgccatcctttgaagacgacctcgcccgccctgccgaagtctccaaggccagccccagagctcagcctcagcagggtatccatcgtcggaccccctattcaacctgtccagagcctggggacccctttgggtccatggccactgccacagcacctgcagcc

SEQ ID NO: 13002 - DNA, 795 bp, Artificial Sequence; identical to SEQ ID NO: 8525
  Synthetic polypeptide

SEQ ID NO: 13003 - DNA, 194 bp, Artificial Sequence; identical to SEQ ID NO: 8526
  Synthetic polypeptide

SEQ ID NO: 13004 - DNA, 462 bp, Artificial Sequence; identical to SEQ ID NO: 8527
  Synthetic polypeptide

SEQ ID NO: 13005 - DNA, 66 bp, Artificial Sequence; identical to SEQ ID NO: 8528
  Synthetic polypeptide

SEQ ID NO: 13006 - DNA, 268 bp, Artificial Sequence; identical to SEQ ID NO: 8529
  Synthetic polypeptide

SEQ ID NO: 13007 - DNA, 132 bp, Artificial Sequence; identical to SEQ ID NO: 8530
  Synthetic polypeptide

SEQ ID NO: 13008 - DNA, 2497 bp, Artificial Sequence
  Synthetic polypeptide
aggaatacttcttacaactgagtatcagaaagaaaatggccacccctgaagaactgccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttag
